US008329667B2

(12) United States Patent
Christiano

(10) Patent No.: US 8,329,667 B2
(45) Date of Patent: Dec. 11, 2012

(54) INHIBITION OF HAIRLESS PROTEIN MRNA

(75) Inventor: Angela M. Christiano, Upper Saddle River, NJ (US)

(73) Assignee: The Trustees of Columbia University in the City of New York, New York, NY (US)

( * ) Notice: Subject to any disclaimer, the term of this patent is extended or adjusted under 35 U.S.C. 154(b) by 26 days.

(21) Appl. No.: 11/333,748

(22) Filed: Jan. 17, 2006

(65) Prior Publication Data

US 2007/0269395 A1 Nov. 22, 2007

Related U.S. Application Data

(63) Continuation of application No. 11/113,423, filed on Apr. 22, 2005, now abandoned.

(60) Provisional application No. 60/565,127, filed on Apr. 23, 2004.

(51) Int. Cl.
A61K 48/00 (2006.01)
C07H 21/02 (2006.01)
C07H 21/04 (2006.01)
C12N 15/85 (2006.01)

(52) U.S. Cl. ......... 514/44; 536/23.1; 536/24.5; 435/325

(58) Field of Classification Search .................. None
See application file for complete search history.

(56) References Cited

U.S. PATENT DOCUMENTS

| 5,160,328 | A | 11/1992 | Cartmell |
| 5,230,896 | A | 7/1993 | Yeh |
| 5,254,346 | A | 10/1993 | Tucker |
| 5,260,066 | A | 11/1993 | Wood |
| 5,334,711 | A | 8/1994 | Sproat |
| 5,627,053 | A | 5/1997 | Usman |
| 5,667,798 | A | 9/1997 | Royds |
| 5,672,695 | A | 9/1997 | Eckstein |
| 5,714,162 | A | 2/1998 | Muller |
| 5,716,824 | A | 2/1998 | Beigelman |
| 5,804,683 | A | 9/1998 | Usman |
| 5,831,071 | A | 11/1998 | Usman |
| 5,854,038 | A | 12/1998 | Sullenger |
| 5,914,126 | A | 6/1999 | Li |
| 5,998,203 | A | 12/1999 | Matulic-Adamic |
| 6,001,311 | A | 12/1999 | Brennan |
| 6,008,400 | A | 12/1999 | Scaringe |
| 6,080,127 | A | 6/2000 | Li |
| 6,087,341 | A | 7/2000 | Khavari |
| 6,111,086 | A | 8/2000 | Scaringe |
| 6,117,657 | A | 9/2000 | Usman |
| 6,248,878 | B1 | 6/2001 | Matulic-Adamic |
| 6,300,074 | B1 | 10/2001 | Gold |
| 6,348,348 | B1 | 2/2002 | Thompson |
| 6,353,098 | B1 | 3/2002 | Usman |
| 6,362,323 | B1 | 3/2002 | Usman |
| 6,437,117 | B1 | 8/2002 | Usman |
| 6,469,158 | B1 | 10/2002 | Usman |
| 6,506,559 | B1 * | 1/2003 | Fire et al. ............ 435/6 |
| 6,989,442 | B2 | 1/2006 | Vargeese |
| 2004/0086945 | A1 * | 5/2004 | Sreekrishna et al. ......... 435/7.1 |
| 2005/0054598 | A1 * | 3/2005 | McSwiggen .................. 514/44 |

FOREIGN PATENT DOCUMENTS

| WO | WO 89/02439 | 3/1989 |
| WO | WO 91/01362 | 2/1991 |
| WO | WO 92/07065 | 4/1992 |
| WO | WO 93/15187 | 8/1993 |
| WO | WO 93/23569 | 11/1993 |
| WO | WO 95/06731 | 3/1995 |
| WO | WO 95/11910 | 5/1995 |
| WO | WO 97/26270 | 7/1997 |
| WO | WO 98/13526 | 4/1998 |
| WO | WO 99/07409 | 2/1999 |
| WO | WO 99/14226 | 3/1999 |
| WO | WO 99/32619 | 7/1999 |
| WO | WO 99/38965 | 8/1999 |
| WO | WO 99/49029 | 9/1999 |
| WO | WO 99/53050 | 10/1999 |
| WO | WO 99/54459 | 10/1999 |
| WO | WO 00/01846 | 1/2000 |
| WO | WO 00/44895 | 4/2000 |
| WO | WO 00/44914 | 8/2000 |
| WO | WO 00/63364 | 10/2000 |
| WO | WO 00/66604 | 11/2000 |
| WO | WO 01/04313 | 1/2001 |
| WO | WO 01/29058 | 4/2001 |
| WO | WO 01/36646 | 5/2001 |
| WO | WO 01/38551 | 5/2001 |
| WO | WO 01/42443 | 6/2001 |
| WO | WO 01/49844 | 7/2001 |
| WO | WO 01/53475 | 7/2001 |
| WO | WO 01/68836 | 9/2001 |
| WO | WO 01/70944 | 9/2001 |
| WO | WO 01/70949 | 9/2001 |
| WO | WO 01/72774 | 10/2001 |

(Continued)

OTHER PUBLICATIONS

Scherer et al., Approaches for the sequence-specific knockdown of mRNA, 2003, Nat. Biotechnol., 21(12), pp. 1457-1465.*
Mahato et al., Modulation of gene expression by antisense and antigene oligodeoxynucleotides and small interfering RNA, Jan. 2005, Expert Opinion on Drug Delivery, vol. 2, No. 1, pp. 3-28.*
Zhang et al., Targeted Gene Silencing by Small Interfering RNA-Based Knock-Down Technology, 2004, Current Pharmaceutical Biotechnology, vol. 5, p. 1-7.*
Bertrand et al. (Biochemical and Biophysical Research Communications, 2002, 296, pp. 1000-1004).*
U.S. Appl. No. 60/311,865, Vargeese.
U.S. Appl. No. 60/082,404, filed Apr. 20, 1998, Thompson.
GenBank Accession No. NM_005144.3 4981 by mRNA linear Definition: *Homo sapiens* hairless homolog (mouse) (HR), transcript variant 1.

(Continued)

*Primary Examiner* — Amy Bowman
(74) *Attorney, Agent, or Firm* — Baker Botts L.L.P.

(57) ABSTRACT

Methods for inhibition of hairless protein mRNA using RNA interference is described, in particular methods for hair removal. Also described are nucleic acid constructs for RNAi-mediated inhibition of hairless protein mRNA and compositions including such constructs.

37 Claims, 4 Drawing Sheets

FOREIGN PATENT DOCUMENTS

| | | |
|---|---|---|
| WO | WO 01/75164 | 10/2001 |
| WO | WO 01/92513 | 12/2001 |
| WO | WO 02/38805 | 5/2002 |
| WO | WO 02/44321 | 6/2002 |
| WO | WO 02/055692 | 7/2002 |
| WO | WO 02/055693 | 7/2002 |
| WO | WO 02/083891 | 10/2002 |
| WO | WO 03/070918 | 8/2003 |
| WO | WO 03/074654 | 9/2003 |
| WO | WO 2005/045036 | 5/2005 |

OTHER PUBLICATIONS

GenBank Accession No. NM_005144. 5699 by mRNA linear Definition: *Homo sapiens* hairless homolog (mouse) transcript variant 1, mRNA.

GenBank Accession No. NM_021877. Definition: *Mus musculus* hairless (Hr), mRNA.

GenBank Accession No. 024364. Definition: *Rattus norvegicus* hairless homolog (mouse) (hr), mRNA.

GenBank Accession No. AY130969. Definition: *Ovis aries* hairless mRNA, partial cds.

GenBank Accession No. AY279972. Definition: *Sus scrofa* hairless mRNA, partial cds.

GenBank Accession No. AF361864. Definition: *Macaca mulatta* hairless mRNA, complete cds.

Beaucage and Iyer. 1993. The functionalization of oligonucleotides via phosphoramidite derivative. Tetrahedron 49:1925-63.

Beigelman et al. 1995. Chemical modification of hammerhead ribozymes. Catalytic activity and nuclease resistance. J. Biol. Chem. 27:25702-8.

Bellon et al. 1997. Amino linked ribozymes: post-synthetic conjugation of half-ribozymes. Nucleosides & Nucleotides. 16:951-54.

Bellon et al. 1997. Post-synthetically ligated ribozymes: an alternative approach to iterative solid-phase synthesis. Bioconjug. Chem. 8:204-12.

Bergeron et al. 2003. Ribozyme-based gene-inactivation systems require a fine comprehension of their substrate specificities; the case of delta ribozyme. Curr. Med. Chem. 10:2589-97.

Bernard et al. 1997. Importance of sebaceous glands in cutaneous penetration of an antiandrogen: target effect of liposomes. J. Pharm. Sci. 86:573-8.

Bernstein et al. 2001. Role for a bidentate ribonuclease in the initiation step of RNA interference. Nature 409:363-6.

Branch. 1998. A good antisense molecule is hard to find. Trends Biochem. Sci. 23:45-50.

Brennan et al. 1998. Two-dimensional parallel array technology as a new approach to automated combinatorial solid-phase organic synthesis. Biotechnol. Bioeng. 61:33-45.

Brody and Gold. 2000. Aptamers as therapeutic and diagnostic agents. J. Biotechnol. 74:5-13.

Burgin et al. 1996. Chemically modified hammerhead ribozymes with improved catalytic rates. Biochemistry. 35:14090-7.

Burlina et al. 1997. Chemical engineering of RNase resistant and catalytically active hammerhead ribozymes. Bioorg. Med. Chem. 5:1999-2010.

Caplen. 2000. dsRNA-mediated gene silencing in cultured *Drosophila* cells: a tissue culture model for the analysis of RNA interference. Gene. 252:95-105.

Caruthers et al. 1992. Chemical synthesis of deoxyoligonucleotides and deoxyoligonucleotide analogs. Meth. Enzymol. 211:3-19.

Cload and Schepartz. 1991. Polyether tethered oligonucleotide probes. J. Am. Chem. Soc. 113:6324-6326.

Cserhalmi-Friedman et al. 2004. Recapitulation of the hairless phenotype using catalytic oligonucleotides: implications for permanent hair removal. Exp. Dermatol. 13:255-263.

De Oliveira et al. 1998. pH-sensitive liposomes as a carrier for oligonucleotides: a physico-chemical study of the interaction between DOPE and a 15-mer oligonucleotide in quasi-anhydrous samples. Biochim. Biophys. Acta 1372:301-10.

Durand et al. 1990. Circular dichroism studies of an oligodeoxyribonucleotide containing a hairpin loop made of a hexaethylene glycol chain: conformation and stability. Nucleic Acids Res. 18:6353-9.

Earnshaw and Gait. 1998. Modified oligoribonucleotides as site-specific probes of RNA structure and function. Biopolymers (Nucleic Acid Sciences). 48:39-55.

Elbashir et al. 2001. Duplexes of 21-nucleotide RNAs mediate RNA interference in cultured mammalian cells. Nature 411:494-8.

Elbashir et al. 2001. RNA interference is mediated by 21- and 22-nucleotide RNAs. Genes Dev. 15:188-200.

Elbashir et al. 2001. Functional anatomy of siRNAs for mediating efficient RNAi in *Drosophila melanogaster* embryo lysate. EMBO J. 20:6877-88.

Ferentz and Verdine. 1991. Disulfide cross-linked oligonucleotides. J. Am. Chem. Soc. 113:4000.

Fire et al. 1998. Potent and specific genetic interference by double-stranded RNA in *Caenorhabditis elegans*. Nature 391:806-11.

Fire. 1999. RNA-triggered gene silencing. Trends Genet. 15:358-63.

Gold et al. 1995. Diversity of oligonucleotide functions. Annu. Rev. Biochem. 64:763-97.

Hammond et al. 2000. An RNA-directed nuclease mediates post-transcriptional gene silencing in *Drosophila* cells. Nature Mar. 16;404(6775):293-6.

Hardy. 1992. The secret life of the hair follicle. Trends Genet. 8:55-61.

Hermann and Patel. 2000. Adaptive recognition by nucleic acid aptamers. Science 287:820-5.

Hudson et al. 1999. Cellular delivery of hammerhead ribozymes conjugated to a transferrin receptor antibody. Int. J. Phann. 182:49-58.

Hughes et al. 2000. In vitro transport and delivery of antisense oligonucleotides. Meth. Enzymol. 313:342-58.

Hunziker and Leumann. 1995. Nucleic acid analogues: synthesis and properties. In *Modern Synthetic Methods*, VCH, 331-417.

Hutvagner et al. 2001. A cellular function for the RNA-interference enzyme Dicer in the maturation of the let-7 small temporal RNA. Science. 293:834-8. Epub Jul. 12, 2001.

Irvine et al. 1996. An autosomal dominant syndrome of acromegaloid facial appearance and generalised hypertrichosis terminalis. J. Med. Genet. 33:972-4.

Jaschke et al. 1993. Automated incorporation of polyethylene glycol into synthetic oligonucleotides. Tetrahedron Lett. 34:301-304.

Jayasena. 1999. Aptamers: an emerging class of molecules that rival antibodies in diagnostics. Clin. Chem. 45:1628-50.

Jen et al. 2000. Suppression of gene expression by targeted disruption of messenger RNA: available options and current strategies. Stem Cells 18:307-319.

Karande et al. 2004. Discovery of transdermal penetration enhancers by high-throughput screening. Nat. Biotechnol. 22:192-7. Epub Jan. 4, 2004.

Karpeisky et al. 1998. Highly efficient synthesis of 2'-O-amino nucleosides and their incorporation in hammerhead ribozymes. Tetrahedron Lett. 39:1131-34.

Kashani-Sabet. 2004. Non-viral delivery of ribozymes for cancer gene therapy. Expert Opin. Biol. Ther. 4:1749-55.

Kusser. 2000. Chemically modified nucleic acid aptamers for in vitro selections: evolving evolution. J. Biotechnol. 74:27-38.

Lewis et al. 1998. Development of a sustained-release biodegradable polymer delivery system for site-specific delivery of oligonucleotides: characterization of P(LA-GA) copolymer microspheres in vitro. J. Drug Target. 5:291-302.

Li et al. 1992. Product-delivering liposomes specifically target hair follicles in histocultured intact skin. In Vitro Cell. Dev. Biol. 28A:679-81.

Lieb et al. 1992. Topical delivery enhancement with multilamellar liposomes into pilosebaceous units: I. In vitro evaluation using fluorescent techniques with the hamster ear model. J. Invest. Dermatol. 99:108-13.

Limbach et al. 1994. Summary: the modified nucleosides of RNA. Nucleic Acids Res. 22):2183-96.

Lin and Matteucci. 1998. A cytosine analogue capable of claim-like binding to a guanine in helical nucleic acids. J. Am. Chem. Soc., 120:8531-8532.

Liu and Saint. 2002. A new quantitative method of real time reverse transcription polymerase chain reaction assay based on simulation of polymerase chain reaction kinetics. Anal. Biochem. 302:52-59.

Ma et al. 1993. Design and synthesis of RNA miniduplexes via a synthetic linker approach. 2. Generation of covalently closed, double-stranded cyclic HIV-1 TAR RNA analogs with high Tat-binding affinity. Nucleic Acids Res. 21:2585-9.

Ma et al. 1993. Design and synthesis of RNA miniduplexes via a synthetic linker approach. Biochemistry. 32:1751-8.

McCurdy et al. 1991. Deoxyoligonucleotides with inverted polarity: synthesis and use in triple-helix formation. Nucleosides & Nucleotides. 10:287-290.

Mesmaeker et al. 1994. Novel backbone replacements for oligonucleotides, In *Carbohydrate Modifications in Antisense Research,* Am. Chem. Soc. 24-39.

Moore and Sharp. 1992. Site-specific modification of pre-mRNA: the 2'-hydroxyl groups at the splice sites. Science. 256:992-7.

Mullins. 1996. Perspective Series: Molecular medicine in genetically engineered animals. J. Clin. Invest. 98 (Supplement):S37-S40.

Nykanen et al. 2001. ATP requirements and small interfering RNA structure in the RNA interference pathway. Cell. 107:309-21.

Ono et al. 1991. DNA triplex formation of oligonucleotide analogues consisting of linker groups and octamer segments that have opposite sugar-phosphate backbone polarities. Biochemistry. 30:9914-2.

Panteleyev et al. 2000. Patterns of hairless (hr) gene expression in mouse hair follicle morphogenesis and cycling. Am. J. Pathol. 157:1071-9.

Panteleyev et al. 1998. Molecular and functional aspects of the hairless (hr) gene in laboratory rodents and humans. Exp. Dermatol. 7:249-67.

Parrish et al. 2000. Functional anatomy of a dsRNA trigger: differential requirement for the two trigger strands in RNA interference. Mol. Cell 6:1077-87.

Perreault et al. 1990. Mixed deoxyribo- and ribo-oligonucleotides with catalytic activity. Nature 344:565-7.

Pieken et al. 1991. Kinetic characterization of ribonuclease-resistant 2'-modified hammerhead ribozymes. Science 253:314-7.

Remington. 1995. The Science and Practice of Pharmacy, 19th Ed. (Easton, Pa.: Mack Publishing Co.), pp. 1399-1404.

Richardson and Schepartz. 1991. Tethered oligonucleotide probes. A strategy for the recognition of structured RNA. J. Am. Chem. Soc. 113:5109.

Rosenquist and Martin. 1996. Fibroblast growth factor signalling in the hair growth cycle: expression of the fibroblast growth factor receptor and ligand genes in the murine hair follicle. Dev. Dyn. 205:379-86.

Saenger. 1984. Principles of Nucleic Acid Structure Springer-Verlag NY. (TOC Only).

Scaringe et al. 1990. Chemical synthesis of biologically active oligoribonucleotides using beta-cyanoethyl protected ribonucleoside phosphoramidites. Nucleic Acids Res. 18:5433-41.

Seela and Kaiser. 1987. Oligodeoxyribonucleotides containing 1,3-propanediol as nucleoside substitute. Nucleic Acids Res. 15:3113-29.

Segre et al. 1995. Positional cloning of the nude locus: genetic, physical, and transcription maps of the region and mutations in the mouse and rat. Genomics 28: 549-559.

Shabarova et al. 1991. Chemical ligation of DNA: the first non-enzymatic assembly of a biologically active gene, Nucleic Acids Res. 19:4247-4251.

Sun. 2000. Technology evaluation: SELEX, Gilead Sciences Inc. Curr. Opin. Mo.1 Ther. 2:100-5.

Tuschl et al. 1999. Targeted mRNA degradation by double-stranded RNA in vitro. Genes Dev. 1999 13:3191-7.

Tuschl. 2001. RNA interference and small interfering RNAs. Chem. Biochem. 2001 2:239-45.

Uhlmann and Peyman. 1990. Antisense oligonucleotides: a new therapeutic principle. Chem. Revs. 90:544-584.

Usman et al. 1994. Chemical modification of hammerhead ribozymes: activity and nuclease resistance. Nucleic Acids Symp. Ser. 31:163.

Usman and Cedergren. 1992. Exploiting the chemical synthesis of RNA. Trends Biochem Sci. 17:334-9.

Usman et al. 1987. Automated chemical synthesis of long oligoribonucleotides using 2'-O-silylated ribonucleotide 3'-O-phosphoramidites on a controlled-pore glass support: Synthesis of a 43-nucleotide sequence similar to the 3' half molecule of an *E. coli* formylmethionine tRNA. J. Am. Chem. Soc. 109:7845-7854.

Verma and Eckstein. 1998. Modified oligonucleotides: synthesis and strategy for users. Annu. Rev. Biochem. 67:99-134.

Wall. 1996. Transgenic livestock: progress and prospects for the future. Theriogenology 45:57-68.

Wianny and Zernicka-Goetz. 2000. Specific interference with gene function by double-stranded RNA in early mouse development. Nat. Cell Biol. 2:70-5.

Wincott et al. 1995. Synthesis, deprotection, analysis and purification of RNA and ribozymes. Nucleic Acids Res. 23:2677-84.

Wincott and Usman. 1997. A practical method for the production of RNA and ribozymes. Methods Mol. Biol. 74:59-68.

Zamore et al. 2000. RNAi: double-stranded RNA directs the ATP-dependent cleavage of mRNA at 21 to 23 nucleotide intervals. Cell 101:25-33.

Zlotogorski et al. 2002. Clinical and molecular diagnostic criteria of congenital atrichia with papular lesions. J. Invest. Dermatol. 118:887-90.

U.S. Appl. No. 11/113,423, filed Apr. 22, 2005.

U.S. Appl. No. 11/113,423, filed Feb. 21, 2006 Notice of Abandonment.

Macron, 2008, "Former Sirna Derm head says technical hurdles hindered hair removal drug." *RNAi News.* Retrieved from the internet; URL: <www.genomeweb.com> on Feb. 20, 2010.

Carrnell, et al., 2003, "Germline transmission of RNAi in mice." *Nature Structural Biology* 10(2):91-92.

* cited by examiner

FIGURE 1

LOCUS       NM_005144    5699 bp    mRNA    linear    PRI 02-MAR-2005
DEFINITION  Homo sapiens hairless homolog (mouse) (HR), transcript variant 1, mRNA
ACCESSION   NM_005144

```
   1 tctcccggga gccactccca tgggcgcctc tccagcccct ggcctggaag caccaggaac
  61 cctggggatg gggcagaccc tcacagcccg gggtctggag ccggtgtcgg agctcatctg
 121 ggcccatgac ctctccagac atttggcaaa atcaaggccc ttagaccagg gacagaccca
 181 agcccaggcc ctcccagagg tcctaggacg caacccttg tgcccttggg ctctggaaga
 241 ggtttgggaa gggtttgggg tggaagatgg caaagagcag cttggccagg tgaggatgag
 301 gcagggcaga cacaggccag tggggcgtgc catgtgccac agatggagag gaccaggagc
 361 cagtggcccg gcaggcacag cccggttggc gtgggccaga gcgcccatca ctgacccgtg
 421 agaactcgac tgccccctgcc agctctggca ctgccccctt ccagccgccc cgccctagca
 481 ccctgggggg caccccgccc aaccgtggcc tggtccggcc cctcccgccc tttgctccag
 541 ttcccgggct tggcacctat agtggggtg ccgcccgcct gccaggctcc ggggccgggc
 601 ccacgggagg gtggggcggc tgggaagctg gcacgctgcc ccggggagc ctctctcggc
 661 aggcgcccgg gtgccgcggg gggaggggg aacaaagggc tcattctccc cgtgcgcagc
 721 cggtggcatc gccggggcgt tggcggaagc ccccggggcc cggggaggggg caggcccagg
 781 cgcggccgcc gaatcacggg ctcctgtttc ccgcagggtg ctggaggagg aaaccggcgg
 841 agcagcttcc ccactctcag ttgcgcttct ggcgatggcg atcagaggtc ctgctgcgct
 901 ctccgccgcg ctctacctcc attagccgcg ctgcgcggtg ctgcgccctc gccggtgcct
 961 ctctcctggg tcccaggatc ggccccacc atccaggcac gacccccttc cccggcccct
1021 cggcctttcc cccaactcgg ccatctccga cccggggcgc gtgttccccc cggcccggcg
1081 ccttctctcc ctccgggggc acccgctccc tagccccggc ccggccctcc ccgcggcgca
1141 gcacggagtc tcggcgtccc atggcgcaac ctacggcctc ggcccagaag ctggtgcggc
1201 cgatccgcgc cgtgtgccgc atcctgcaga tcccggagtc cgacccctcc aacctgcggc
1261 cctagagcgc ccccgccgcc ccggggaag gagagcgcga gcgcgctgag cagacagagc
1321 gggagaacgc gtcctcgccc gccggccggg aggccccgga gctggcccat ggggagcagg
1381 cgcccggtgc cggccacgac gaccgccacc gccgcgccg cgaccggccg gtgaagccca
1441 gggacccccc tctgggagag cccccatgagg gcaggagagt gatggagagt acgcccagct
1501 tcctgaaggg caccccaacc tgggagaaga cggcccccaga gaacggcatc gtgagacagg
1561 agcccggcag cccgcctcga gatggactgc accatgggcc gctgtgcctg ggagagcctg
1621 ctccctttg gagggcgtc ctgagcaccc cagactcctg gcttccccct ggcttccccc
1681 agggccccaa ggacatgctc ccacttgtgg agggcgaggg cccccagaat ggggagagga
1741 aggtcaactg gctggcagc aaagagggac tgcgctggaa ggaggccatg cttaccccatc
1801 cgctggcatt ctgcgggcca gcgtgcccac ctcgctgtgg ccccctgatg cctgagcata
1861 gtggtggcca tctcaagagt gaccctgtgg ccttccggcc ctggcactgc cttttccttc
1921 tggagaccaa gatcctggag cgagctccct tctgggtgcc cacctgcttg ccacccctacc
1981 tagtgtctgg cctgccccca gagcatccat gtgactggcc cctgaccccg caccctggg
2041 tatactccgg gggccagccc aaagtgccct ctgccttcag cttaggcagc aagggctttt
2101 actacaagga tccgagcatt cccaggttgg caaggagcc cttggcagct gcggaacctg
2161 ggttgtttgg cttaaactct ggtgggcacc tgcagagagc cggggaggcc gaacgccctt
2221 cactgcacca gagggatgga gagatgggag ctggccggca gcagaatcct tgcccgctct
2281 tcctgggca gccagacact gtgccctgga cctcctggcc cgcttgtccc ccaggccttg
2341 ttcatactct tggcaactc tgggctgggc caggcgatgg gaaccttggg taccagctgg
2401 ggccaccagc aacaccaagg tgcccctctc ctgagccgcc tgtcacccag cggggctgct
2461 gttcatccta cccacccact aaaggtgggg gtcttggccc ttgctggaag tgccaggagg
2521 gcctgagggg gggtgccagt ggagccagcg aacccagcga ggaagtgaac aaggcctctg
2581 gccccagggc ctgtcccccc agccaccaca ccaagctgaa gaagacatgg ctcacacggc
```

FIGURE 1 (cont)

```
2641 actcggagca gtttgaatgt ccacgcggct gccctgaggt cgaggagagg ccggttgctc
2701 ggctccgggc cctcaaaagg gcaggcagcc ccgaggtcca gggagcaatg ggcagtccag
2761 cccccaagcg gccaccggac ccttttccag gcactgcaga acaggggget ggggttggc
2821 aggaggtgcg ggacacatcg ataggaaca aggatgtgga ctcgggacag catgatgagc
2881 agaaaggacc ccaagatggc caggccagtc tccaggaccc gggacttcag gacataccat
2941 gcctggctct ccctgcaaaa ctggctcaat gccaaagttg tgcccaggca gctggagagg
3001 gaggagggca cgcctgccac tctcagcaag tgcggagatc gcctctggga ggggagctgc
3061 agcaggagga agacacagcc accaactcca gctctgagga aggcccaggg tccggccctg
3121 acagccggct cagcacaggc ctcgccaagc acctgctcag tggtttgggg gaccgactgt
3181 gccgcctgct gcggagggag cgggaggccc tggcttgggc ccagcgggaa ggccaagggc
3241 cagccgtgac agaggacagc ccaggcattc cacgctgctg cagccgttgc caccatggac
3301 tcttcaacac ccactggcga tgtccccgct gcagccaccg gctgtgtgtg gcctgtggtc
3361 gtgtggcagg cactgggcgg gccagggaga aagcaggctt tcagagcag tccgcggagg
3421 agtgcacgca ggaggccggg cacgctgcct gttccctgat gctgacccag tttgtctcca
3481 gccaggcttt ggcagagctg agcactgcaa tgcaccaggt ctgggtcaag tttgatatcc
3541 gggggcactg cccctgccaa gctgatgccc gggtatgggc cccggggat gcaggccagc
3601 agaaggaatc aacacagaaa acgccccaa ctccacaacc ttcctgcaat ggcgacaccc
3661 acaggaccaa gagcatcaaa gaggagaccc ccgattccgc tgagacccca gcagaggacc
3721 gtgctggccg agggcccctg ccttgtcctt ctctctgcga actgctggct tctaccgcgg
3781 tcaaactctg cttgggccat gagcgaatac acatggcctt cgccccgtc actccggccc
3841 tgcccagtga tgaccgcatc accaacatcc tggacagcat tatcgcacag gtggtggaac
3901 ggaagatcca ggagaaagcc ctggggccgg ggcttcgagc tggcccgggt ctgcgcaagg
3961 gcctgggcct gcccctctct ccagtgcggc cccggctgcc tcccccaggg gctttgctgt
4021 ggctgcagga gccccagcct tgccctcggc gtggcttcca cctcttccag gagcactgga
4081 ggcagggcca gcctgtgttg gtgtcaggga tccaaaggac attgcagggc aacctgtggg
4141 ggacagaagc tcttggggca cttggaggcc aggtgcaggc gctgagcccc ctcggacctc
4201 cccagcccag cagcctgggc agcacaacat tctgggaggg cttctcctgg cctgagcttc
4261 gcccaaagtc agacgagggc tctgtcctcc tgctgcaccg agctttgggg gatgaggaca
4321 ccagcagggt ggagaaccta gctgccagtc tgccacttcc ggagtactgc gccctccatg
4381 gaaaactcaa cctgcttcc tacctcccac cgggccttgc cctgcgtcca ctggagcccc
4441 agctctgggc agcctatggt gtgagcccgc accggggaca cctggggacc aagaacctct
4501 gtgtggaggt ggccgacctg gtcagcatcc tggtgcatgc cgacacacca ctgcctgcct
4561 ggcaccgggc acagaaagac ttcctttcag gcctggacgg ggaggggctc tggtctccgg
4621 gcagccaggt cagcactgtg tggcacgtgt tccgggcaca ggacgcccag cgcatccgcc
4681 gctttctcca gatggtgtgc ccggccgggg caggcgccct ggagcctggc gccccaggca
4741 gctgctacct ggatgcaggg ctgcggcggc gcctgcggga ggagtggggc gtgagctgct
4801 ggaccctgct ccaggccccc ggagaggccg tgctggtgcc tgcaggggct ccccaccagg
4861 tgcagggcct ggtgagcaca gtcagcgtca ctcagcactt cctctcccct gagacctctg
4921 ccctctctgc tcagctctgc caccagggac ccagccttcc ccctgactgc cacctgcttt
4981 atgcccagat ggactgggct gtgttccaag cagtgaaggt ggccgtgggg acattacagg
5041 aggccaaata gagggatgct aggtgtctgg gatcggggtg gggacaggta gaccaggtgc
5101 tcagcccagg cacaacttca gcagggatg gcgctagggg acttggggat ttctggtcaa
5161 ccccacaagc accactctgg gcacaagcag ggcactctgt tcccctcccc cttaagccaa
5221 caaccacagt gccaccaagc tcacacctgt ccttctcagg ctggcatctc ccccaccctg
5281 tgcccctttt catggtacca ggcccgcact ggggggcaatt gacttcctcc aatccccact
5341 cctccgagac ccaggagaca aacagccctt ccttggggaa acttgggaat cattctggct
5401 taaacaacac ctcctcctgc tgctcactcc cgctgagccc actctactgc cccagctccg
5461 tttctaccac cgcatcctca ctgggctcac tgcaggcatg ctgaacaagg ggcctccaac
5521 cttctgccct cctgccaaaa gatctgggga gtgtgaggag agggtggcat caggagctgc
5581 tcaggcttgg cggagggagc ggcatgggcg atgtcactca gccccttccc ggtccgcccg
5641 cttccctcct tcatgatttc cattaaagtc tgttgttttg tgaaaaaaaa aaaaaaaa
```

FIGURE 2

LOCUS NM_005144 4981 bp mRNA linear PRI 19-APR-2005
DEFINITION Homo sapiens hairless homolog (mouse) (HR), mRNA
ACCESSION NM_005144 VERSION NM_005144.3 GI:62750351

```
   1 ggccccggag ctggcccatg gggagcaggc gcccggtgcc ggccacgacg accgccaccg
  61 cccgcgccgc gaccggccgg tgaagcccag ggacccccct ctgggagagc cccatgaggg
 121 caggagagtg atggagagta cgcccagctt cctgaagggc accccaacct gggagaagac
 181 ggccccagag aacggcatcg tgagacagga gcccggcagc ccgcctcgag atggactgca
 241 ccatgggccg ctgtgcctgg gagagcctgc tcccttttgg aggggcgtcc tgagcacccc
 301 agactcctgg cttccccctg gcttccccca gggcccaag gacatgctcc cacttgtgga
 361 gggcgaggc ccccagaatg gggagaggaa ggtcaactgg ctgggcagca aagagggact
 421 gcgctggaag gaggccatgc ttacccatcc gctggcattc tgcgggccag cgtgcccacc
 481 tcgctgtggc ccctgatgc ctgagcatag tggtggccat ctcaagagtg accctgtggc
 541 cttccggccc tggcactgcc ctttccttct ggagaccaag atcctggagc gagctccctt
 601 ctgggtgccc acctgcttgc caccctacct agtgtctggc ctgccccag agcatccatg
 661 tgactggccc ctgacccgc accctgggt atactccggg ggccagccca aagtgccctc
 721 tgccttcagc ttaggcagca agggctttta ctacaaggat ccgagcattc ccaggttggc
 781 aaaggagccc tggcagctg cggaacctgg gttgtttggc ttaaactctg gtgggcacct
 841 gcagagagcc ggggaggccg aacgcccttc actgcaccag agggatggag agatgggagc
 901 tggccggcag cagaatcctt gcccgctctt cctggggcag ccagacactg tgccctggac
 961 ctcctggccc gcttgtcccc caggccttgt tcatactctt ggcaacgtct gggctgggcc
1021 aggcgatggg aaccttgggt accagctggg gccaccagca acaccaaggt gccctctcc
1081 tgagccgcct gtcacccagc ggggctgctg ttcatcctac ccacccacta aggtgggg
1141 tcttggccct tgtgggaagt gccaggaggg cctggagggg ggtgccagtg gagccagcga
1201 acccagcgag gaagtgaaca aggcctctgg ccccagggcc tgtccccca gccaccacac
1261 caagctgaag aagacatggc tcacacggca ctcggagcag tttgaatgtc cacgcggctg
1321 ccctgaggtc gaggagaggc cggttgctcg gctccgggcc ctcaaaaggg caggcagccc
1381 cgaggtccag ggagcaatgg gcagtccagc ccccaagcgg ccaccggacc cttttccagg
1441 cactgcagaa caggggctg ggggttggca ggaggtgcgg gacacatcga tagggaacaa
1501 ggatgtggac tcgggacagc atgatgagca gaaaggaccc caagatggcc aggccagtct
1561 ccaggacccg ggacttcagg acataccatg cctggctctc cctgcaaaac tgctcaatg
1621 ccaaagttgt gcccaggcag ctggagaggg aggagggcac gcctgccact ctcagcaagt
1681 gcggagatcg cctctgggag gggagctgca gcaggaggaa gacacagcca ccaactccag
1741 ctctgaggaa ggcccagggt ccggccctga cagccggctc agcacaggcc tgccaagca
1801 cctgctcagt ggtttggggg accgactgtg ccgcctgctg cggagggagc gggaggccct
1861 ggcttgggcc cagcggttaag gccaagggcc agccgtgaca gaggacagcc caggcattcc
1921 acgctgctgc agccgttgcc accatggact cttcaacacc cactggcgat gtccccgctg
1981 cagccaccgg ctgtgtgtgg cctgtggtcg tgtggcaggc actgggcggg cagggagaa
2041 agcaggcttt caggagcagt ccgcggagga gtgcacgcag gaggccgggc acgctgcctg
2101 ttccctgatg ctgacccagt ttgtctccag ccaggctttg gcagagctga gcactgcaat
2161 gcaccaggtc tgggtcaagt ttgatatccg ggggcactgc ccctgccaag ctgatgcccg
2221 ggtatgggcc cccggggatg caggccagca gaaggaatca acacagaaaa cgcccccaac
2281 tccacaacct tcctgcaatg gcgacaccca caggaccaag agcatcaaag aggagacccc
2341 cgattccgct gagacccag cagaggaccg tgctggccga gggcccctgc cttgtccttc
2401 tctctgcgaa ctgctggctt ctaccgcggt caaactctgc ttgggccatg agcgaataca
2461 catggccttc gcccccgtca ctccggccct gcccagtgat daccgcatca ccaacatcct
2521 ggacagcatt atcgcacagg tggtggaacg gaagatccag gagaaagccc tggggccggg
```

FIGURE 2 (cont)

```
2581 gcttcgagct ggcccgggtc tgcgcaaggg cctgggcctg ccctctctc cagtgcggcc
2641 ccggctgcct cccccagggg ctttgctgtg gctgcaggag ccccagcctt gccctcggcg
2701 tggcttccac ctcttccagg agcactggag gcagggccag cctgtgttgg tgtcagggat
2761 ccaaaggaca ttgcagggca acctgtgggg gacagaagct cttggggcac ttggaggcca
2821 ggtgcaggcg ctgagccccc tcggacctcc ccagcccagc agcctgggca gcacaacatt
2881 ctgggagggc ttctcctggc ctgagcttcg cccaaagtca gacgagggct ctgtcctcct
2941 gctgcaccga gctttggggg atgaggacac cagcagggtg gagaacctag ctgccagtct
3001 gccacttccg gagtactgcg ccctccatgg aaaactcaac ctggcttcct acctcccacc
3061 gggccttgcc ctgcgtccac tggagcccca gctctgggca gcctatggtg tgagcccgca
3121 ccggggacac ctggggacca agaacctctg tgtggaggtg gccgacctgg tcagcatcct
3181 ggtgcatgcc gacacaccac tgcctgcctg gcaccgggca cagaaagact tcctttcagg
3241 cctggacggg gaggggctct ggtctccggg cagccaggtc agcactgtgt ggcacgtgtt
3301 ccgggcacag gacgcccagc gcatccgccg ctttctccag atggtgtgcc cggccggggc
3361 aggcgccctg gagcctggcg ccccaggcag ctgctacctg gatgcaggc tgcggcggcg
3421 cctgcgggag gagtggggcg tgagctgctg gaccctgctc caggcccccg gagaggccgt
3481 gctggtgcct gcaggggctc cccaccaggt gcagggcctg gtgagcacag tcagcgtcac
3541 tcagcacttc ctctcccctg agacctctgc cctctctgct cagctctgcc accagggacc
3601 cagccttccc cctgactgcc acctgcttta tgcccagatg gactgggctg tgttccaagc
3661 agtgaaggtg gccgtgggga cattacagga ggccaaatag agggatgcta ggtgtctggg
3721 atcggggtgg ggacaggtag accaggtgct cagcccaggc acaacttcag caggggatgg
3781 cgctagggga cttggggatt tctggtcaac cccacaagca ccactctggg cacaagcagg
3841 gcactctgtt cccctccccc ttaagccaac aaccacagtg ccaccaagct cacacctgtc
3901 cttctcaggc tggcatctcc cccaccctgt gcccttttc atggtaccag gcccgcactg
3961 ggggcaattg acttcctcca atccccactc ctccgagacc caggagacaa acagcccttc
4021 cttgggaaa cttgggaatc attctggctt aaacaacacc tcctcctgct gctcactccc
4081 gctgagccca ctctactgcc ccagctccgt ttctaccacc gcatcctcac tgggctcact
4141 gcaggcatgc tgaacaaggg gcctccaacc ttctgccctc ctgccaaaag atctggggag
4201 tgtgaggaga gggtggcatc aggagctgct caggcttggc ggagggagcg gcatgggcga
4261 tgtcactcag ccccttcccg gtccgcccgc ttccctcctt catgatttcc attaaagtct
4321 gttgttttgt gactgctgcc agtgtggttg gccctgcccc tgcaggccac atggtccagg
4381 gagggagggg gacatggaaa tctgccttag agacaaatgg agtagggcag cccggagctg
4441 gggcccaagg gacaggacac cactgcctgc tcttcgtctg gggcctgggg ccttgcctcc
4501 cactgaggag actttgggtg gggtggggg ctgtccccca aagatgctcc tgagtgcaag
4561 agcaggcaag gcagagtcct ggggcacagc cacgaggtga cctccctgtg cagagactcc
4621 cgagccctac tccacccagc aagctccagt ccgcccatc tctccgtct accctgacct
4681 ggagatccag aagtatggcc cagaagagcc cttgccccgc ctgtctgccc ttggtggcag
4741 tggccatggc cgacgccagg cccagccacc ctgggactga gcctgactgc ttcagacagc
4801 cgacccctcc ttgtccccgc tccacgcccg cagcctcctg gtggcgctcc gccctctccc
4861 gcttcctttg tgtatctcag ccctacaaag aaaaacactc ccactcttgt catacctaat
4921 tgttcctgct gtggtttggg gaatttttt tattaaataa agttttttat tataagggta
4981 a
```

INHIBITION OF HAIRLESS PROTEIN MRNA

CROSS-REFERENCE TO RELATED PATENT APPLICATIONS

This application is a continuation of U.S. application Ser. No. 11/113,423 filed Apr. 22, 2005, now abandoned which is based on U.S. Provisional Application Ser. No. 60/565,127 filed Apr. 23, 2004, the contents of each of which are incorporated by reference herein, and to each of which priority is claimed.

SEQUENCE LISTING

The specification further incorporates by reference a substitute Sequence Listing submitted via EFS on Jul. 2, 2007. Pursuant to 37 C.F.R. §1.52(e)(5), the substitute Sequence Listing text file, identified as 700503051.txt, is 2.0 Mb and was created on Jul. 2, 2007. The substitute Sequence Listing, electronically filed herewith, does not extend beyond the scope of the specification and thus does not contain new matter.

The sequence listing, submitted in duplicate on compact disk (CD), in lieu of a paper copy in compliance with 37 C.F.R. §§1.821(c) and 1.52(e), and in duplicate on CD (CRF copy), in compliance with 37 C.F.R. §1.821 (e) has been generated from the specification and figures and does not constitute new matter. The Sequence Listing has been prepared using FastSeq for Windows Version 4.0 software. Four identical CDs, labeled COPY 1, COPY 2, CRF of Sequence Listing submitted under 37 C.F.R. §1.821(e)—COPY 1 and CRF of Sequence Listing submitted under 37 C.F.R. §1.821 (e)—COPY 2, (total four (4) CDs), created on Apr. 22, 2005 each contain file: "AP36462_SEQLIST.TXT", of size 2.28 MB (2,398,842 bytes). The specification incorporates herein by reference, the CD copies of the Sequence Listing submitted under 37 C.F.R §§1.821(c) and 1.52(e). The sequence listing, submitted herewith, does not extend beyond the scope of the specification, and thus, does not contain new matter.

BACKGROUND OF THE INVENTION

The following is a discussion of some relevant art relating to hairless protein, and to RNAi. This discussion is provided only to assist the understanding of the reader, and does not constitute an admission that any of the information provided or references cited constitutes prior art to the present invention.

As described in Christiano et al., PCT/US99/02128, WO 99/38965, The human hair follicle is a dynamic structure which generates hair through a complex and highly regulated cycle of growth and remodeling. Hardy, 1992, *Trends Genet.* 8:159; Rosenquist and Martin, 1996, *Dev. Dynamics* 205: 379. Hair growth is typically described as having three distinct phases. In the first phase, knows as anagen, the follicle is generated and new hair grows.

During the second phase, known as catagen, the follicle enters the stage where elongation ceases and the follicle regresses because the matrix cells stop proliferating. At this stage, the lower, transient half of the follicle is eliminated due to terminal differentiation and keratinization, and programmed cell death. Rosenquist and Martin, 1996, *Dev. Dynamics* 205:379. Also during catagen, although the dermal papilla remains intact, it undergoes several remodeling events, including degradation of the extracellular matrix that is deposited during anagen. At the close of catagen, the hair is only loosely anchored in a matrix of keratin, with the dermal papilla located just below. The catagen stage occurs at a genetically predetermined time, which is specific for each hair type in a species.

The third phase, known as telogen, is characterized by the follicle entering a quiescent phase, during which the hair is usually shed. When a new hair cycle is initiated, it is thought that a signal from the dermal papilla stimulates the stem cells, which are thought to reside in the permanent portion of the follicle, to undergo a phase of downward proliferation and genesis of a new bulbous base containing matrix cells which then surround the dermal papilla. As the new anagen state progresses, these hair matrix cells produce a new hair, the cycle begins again. Each follicle appears to be under completely asynchronous control, resulting in a continuum of follicles in anagen, catagen, and telegen phases, leading to a relatively homogeneous hair distribution. Hardy, 1992, *Trends Genet.* 8:159; Rosenquist and Martin, 1996, *Dev. Dynamics* 205:379.

Christiano et al., PCT/US99/02128, WO 99/38965 describes isolated nucleic acid encoding human hairless protein, the isolated protein, and methods for identifying a compound that is capable of enhancing or inhibiting expression of a human hairless protein, and states that "A therapeutic approach using antisense to human hairless can be used to directly interfere with the translation of Human hairless protein messenger RNA into protein." It further states that "antisense nucleic acid or ribozymes could be used to bind to the Human hairless protein mRNA or to cleave it."

Thompson, U.S. Pat. No. 6,348,348, issued Feb. 19, 2002, describes human hairless gene and protein, and screening methods to identify agents that affect expression of the human hairless gene.

Christiano, U.S. patent application Ser. No. 10/122,013, publication 20030077614 (and corresponding Internation Application PCT/US02/11683, WO 02/083891), indicates that "The present invention provides DNAzymes and ribozymes that specifically cleave Hairless Protein mRNA." The present invention also provides antisense oligonucleotides that specifically inhibit translation of Hairless Protein mRNA. (Abstract.) Also, it states that "This invention provides a nucleic acid molecule that specifically hybridizes to Hairless Protein mRNA so as to inhibit the translation thereof in a cell"; (Specification ¶ 0099) and that "Antisense oligodeoxynucleotides were synthesized as directed to the inhibition of Hairless expression based on the Hairless mRNA sequence."

SUMMARY OF THE INVENTION

The present invention concerns the use of RNA interference (RNAi) to inhibit mRNA's involved in hair growth, resulting in inhibition of hair growth. For many applications, short interfering RNA (siRNA) are used. Thus, inhibition of hairless protein mRNA, particularly during catagen phase, can result in permanent or at least long term inhibition of hair growth, and thus provides a method for hair removal. Consequently, inhibition of hairless protein mRNA can be used for hair removal and/or hair growth inhibition in cosmetic, therapeutic, and industrial applications.

Thus, in a first aspect, the invention provides a method for hair removal from a mammal, e.g., a human. The method involves applying to a human in an area comprising hair follicles a double stranded nucleic acid molecule that includes a sequence of at least a portion of human hairless protein mRNA and a sequence complementary thereto.

In particular embodiments, the inhibition of hair growth in the treated area persists at least 1, 2, 4, 6, 8, 10, 12, or 24 months, or longer, or permanently.

In certain embodiments, the method also involves synchronizing hair growth cycles for hair follicles in the treated area, e.g., by extracting hairs such as by waxing. Such extraction causes follicles in anagen to transition into catagen thereby making those follicles susceptible to inhibition using this invention, and triggers new hair growth of follicles in telogen and thus makes those follicles suitable for transitioning into catagen. Thus, these methods synchronize hair follicles in the hair cycle.

As used in connection with this invention, the term "hair removal" refers to physical removal and continuing inhibition of hair growth from one or more hair follicles. Typically the hair removal applies to a plurality of hair follicles in a skin area on a subject. For example, the area can be up to 2, 5, 10, 20, 50, 100, 200, 400, or more $cm^2$. For hair removal in an area, the hair removal may apply to all or a fraction of the hair follicles in the area.

The term "hair follicle" is used conventionally to refer to a biological hair producing structure.

As used in connection with the present methods, the term "applying" indicates that a substance is placed such that the substance is physically present on or in an area.

The term "nucleic acid molecule" refers to a polymer that includes a plurality of linked nucleotides or nucleotide analogs, and may include one or more modified internucleotidic linkages.

The term "hairless gene" refers to a mammalian gene that corresponds to reference human cDNA GenBank reference number NM_005144, FIG. 1 (SEQ ID NO: 11412) and version NM_005144.3, GI:62750351, FIG. 2 (SEQ ID NO:11413), recognizing that polymorphisms and potentially sequencing errors may be present, or a species homolog of that sequence, e.g., mouse homolog cDNA sequence NM_021877. Similarly the terms "hairless protein mRNA" and "hairless mRNA" refer to an mRNA encoding a hairless gene protein, and "human hairless mRNA" refers to a human homolog of such mRNA.

The phrase "inhibition of hair growth" is used to refer to a reduction or stoppage of hair growth caused at least in part by an agent not normally present in cells in a hair follicle.

As used herein, the phrase "synchronizing hair growth cycles" means that at least 10% of hair follicles in catagen or telogen phase in a particular area are caused to enter anagen phase essentially simultaneously (i.e., within 2 weeks). Such synchronizing can be accomplished, for example, with a physical action such as hair extraction or with one or more chemical or biomolecular agents.

As used herein, the term "hair extraction" refers to pulling of individual hair shafts out of their follicles.

A related aspect concerns a method for hair removal from an area of a mammal comprising hair follicles, where the method involves applying to the area a composition that includes at least one double stranded nucleic acid molecule able to inhibit hairless mRNA translation in vitro.

In certain embodiments, the method also includes synchronizing hair growth cycles for hair follicles in the treated area, such as by hair extraction, e.g., using waxing; the mammal is a human; the mammal is a mouse; the mammal is a rat; the mammal is a bovine.

In another aspect, the invention provides a method of inhibiting expression of hairless protein in a mammal. The method involves administering a double stranded nucleic acid molecule to the mammal, where the double stranded nucleic acid molecule includes a sequence selected from the group consisting of oligonucleotides 1-5664 and their respective antisense sequences, or the species homology of such sequences, and a sequence complementary thereto.

As used in the context of this invention, the term "inhibiting expression" indicates that the level of mRNA and/or corresponding protein or rate of production of the corresponding protein in a cell that would otherwise produce the mRNA and/or protein is reduced as compared to a non-inhibited but otherwise equivalent cell. Reduction in the rate of production can be at various levels, including stopping such production.

The term "species homolog" refers to a form of a gene, or corresponding nucleic acid molecule, or polypeptide from a particular species that is sufficiently similar in sequence to the gene, corresponding nucleic acid, or polypeptide from a reference species that one skilled in the art recognizes a common evolutionary origin.

Thus, as used in connection with a molecule or composition, the phrase "able to inhibit hairless mRNA translation" indicates that the molecule or composition has the property that when present in a cell that would translate hairless mRNA to produce protein in the absence of an inhibitor, the molecule or composition reduces the rate of biosynthesis of hairless protein (or even eliminate such biosynthesis). Such reduction can occur in various ways, for example, by reducing the amount of mRNA available for translation or by at least partially blocking translation of mRNA that is present.

Reference to Oligonucleotides by number utilizes the oligonucleotide numbering in Table 1, and therefore, specifies a nucleotide sequence.

In particular embodiments, the mammal is a human, a mouse, a rat, a bovine (such as a cow), an ovine (such as a sheep), a monkey, a porcine (such as domestic pig).

The term "bovine" is used conventionally to refer to cattle, oxen, and closely related ruminants.

Another aspect concerns a method for treating a human desirous of losing hair. The method involves administering to the human a composition that includes a double stranded nucleic acid molecule that includes a sequence of at least a portion of human hairless protein mRNA and a sequence complementary thereto.

As used herein, the phrase "desirous of losing hair" refers to an objective indication of consent or request for a process to remove hair from a body area in a manner reducing or eliminating future hair growth in that area for a period of time, e.g., at least 1 week, 2 weeks, 1 month, 2 months, or longer.

A further aspect concerns a method for marketing a composition for hair removal, which includes providing for sale to medical practitioners (e.g., doctors, nurse practitioners, doctor's assistants, and nurses) or to the public (e.g., spas and other body care businesses, and individuals) a packaged pharmaceutical composition that includes a double stranded nucleic acid molecule containing a sequence of at least a portion of human hairless protein mRNA and a sequence complementary thereto; and a package label or insert indicating that the pharmaceutical composition can be used for hair removal.

In particular embodiments, the pharmaceutical composition is approved by the U.S. Food and Drug Administration, and/or by an equivalent regulatory agency in Europe or Japan, for hair removal in humans; the pharmaceutical composition is packaged with a hair removal wax or other component adapted for hair removal.

The term "pharmaceutical composition" refers to a substance that contains at least one biologically active component. The composition typically also contains at least one pharmaceutically acceptable carrier or excipient.

As used herein, the term "packaged" means that the referenced material or composition is enclosed in a container or containers in a manner suitable for storage or transportation. For example, a pharmaceutical composition may be sealed in a vial, bottle, tube, or the like, which may itself be inside a box. Typically, a label on the container identifies the contents and may also provide instructions for use and/or cautions to prevent misuse.

The term "hair removal wax" refers to refer to a substance that is adapted for removal of hair by embedding hair in the substance and then pulling the material away, thereby pulling embedded hairs out of the hair follicles. The substance may be used with a backing material such as paper or cloth. Both hot and cold waxes are commonly available. Unless clearly indicated, the term is not limited to substances that are chemically waxes; for example, the term will generally include substances such as caramel-based substances that are used for "sugaring".

The term "other component adapted for hair removal" refers to a material or device that can be used for physically removing hairs and is either generally recognized as suitable for such use, of instructions are provided indicating that the component can be used for physical hair removal or providing instructions on performing such removal.

Another aspect concerns an isolated double stranded nucleic acid molecule that includes a nucleotide sequence corresponding to 19-25 contiguous nucleotides from human hairless mRNA, where the nucleotide sequence contains a nucleotide sequence selected from the group consisting of oligonucleotides 1-5664; and a nucleotide sequence complementary thereto, where the double stranded nucleic acid molecule induces RNA interference in a human cell in vitro.

Indication that a molecule or material of interest "induces RNA interference in a human cell in vitro" means that when present in cultured cells that are capable of RNA interference and under conditions such that a molecule or molecules that will normally induce RNA interference do induce RNAi in the cell, the molecule or material of interest will induce such RNA interference.

Likewise, in another aspect the invention provides a pharmaceutical composition that includes a double stranded nucleic acid molecule that contains a nucleotide sequence corresponding to 14-50, 17-40, 17-30, 17-25, 19-30, 19-29, 19-28, 19-26, 19-25, 19-24, 19-23, 20-23, 20-22, or 21-22 contiguous nucleotides from human hairless mRNA including a nucleotide sequence selected from the group consisting of oligonucleotides 1-5664, and a sequence complementary thereto, wherein said double stranded nucleic acid molecule induces RNA interference in a human cell in vitro.

In yet another aspect, the invention provides a kit that includes a pharmaceutical composition that contains a double stranded nucleic acid molecule that includes a sequence of at least a portion of human hairless protein mRNA and a sequence complementary thereto; and a package label or insert indicating that said pharmaceutical composition can be used for hair removal.

In certain embodiments, the kit is approved by the U.S. Food and Drug Administration or equivalent regulatory agency in Europe or Japan, for human hair removal.

In certain embodiments of the above aspects or other aspects described herein, the double stranded nucleic acid includes at least one (i.e., one or two) 3'-overhang, e.g., a 1, 2, or 3 nucleotide overhang. In certain embodiments, such overhang includes one or more non-ribonucleotides; includes 1, 2, or 3 deoxynucleotide; includes a modified linkage; each strand has a 1, 2, or 3 nucleotide overhang.

In certain embodiments of the above aspects, at least one strand of the double stranded nucleic acid includes at least one nucleotide analog or internucleotidic linkage different from unmodified RNA; each strand includes at least one nucleotide analog or internucleotidic linkage different from unmodified RNA; at least one strand includes at least one modified nucleotide; each strand includes at least one modified nucleotide.

In certain embodiments of the above aspects, the double stranded nucleic acid molecule induces RNA interference in a cell in vitro and includes the RNA sense sequence of Oligonucleotide 131, namely 5'-CUCUCCAGACAUUUG-GCAA-3' (SEQ ID NO: 11329), and its complementary RNA sequence 5'-TTGCCAAATGTCTGGAGAG-3' (SEQ ID NO:262); includes the RNA sense sequence of Oligonucleotide 1194, namely 5'-GUGCGGCCGAUCCGCGCCG-3' (SEQ ID NO: 11330), and its complementary RNA sequence 5'-CGGCGCGGAUCGGCCGCAC-3' (SEQ ID NO:11331); includes the RNA sense sequence of Oligonucleotide 1521, namely 5'-TGGGAGAAGACGGCCCCAG-3' (SEQ ID NO:3041) its complementary RNA sequence 5'-CTGGGGC-CGTCTTCTCCCA-3' (SEQ ID NO: 3042); includes an RNA sense sequence and a complementary RNA antisense sequence selected from the group consisting of oligonucleotides 1-5664; is targeted to hairless mRNA corresponding to a site in the coding sequence (CDS) covering nucleotides 1482 to 5051; includes a nucleotide sequence corresponding to an oligonucleotide selected from Oligonucleotides 1482 to 5032; includes a nucleotide sequence corresponding to an oligonucleotide selected from Oligonucleotides 1482 to 4032; includes a nucleotide sequence corresponding to an oligonucleotide selected from Oligonucleotides 1482 to 3032; includes a nucleotide sequence corresponding to an oligonucleotide selected from Oligonucleotides 1482 to 2032; includes a nucleotide sequence corresponding to an oligonucleotide selected from Oligonucleotides 1582 to 1732.

In certain embodiments of the above aspects, in the double stranded nucleic acid molecule, the sense sequence and the antisense sequence each include 19, 20, 21, 22, 23, 24, 25, 26, 27, 28, or 29 complementary nucleotides and 1 to 3 non-complementary 3'-nucleotides.

In certain embodiments of the above aspects, chemically modified nucleic acids are used, e.g., chemically modified siRNAs (siNAs) as described in McSwiggen et al., PCT/US03/05346, WO 03/070918, which is incorporated herein by reference.

As used herein, the terms "siRNA" and "siNA" both refer to double stranded nucleic acid that induces RNAi, and includes unmodified RNA oligonucleotides and chemically modified oligonucleotides. When unmodified RNA is intended, the term "unmodified RNA" is expressly used.

The term "RNAi inducing oligonucleotide" or "RNA interference inducing oligonucleotide" refers to an oligonucleotide, generally a double stranded molecule (usually an siRNA molecule), that is able to induce RNA interference in a suitable cell.

In certain embodiments of the above aspects involving application of the present oligonucleotides to a mammal, the oligonucleotides are applied at 0.01 to 0.1 microgram/cm$^2$, 0.1 to 0.2 microgram/cm$^2$, 0.2 to 0.5 microgram/cm$^2$, 0.5 to 1.0 microgram/cm$^2$, 1.0 to 2.0 microgram/cm$^2$, 2.0 to 5.0 microgram/cm$^2$, or 5.0 to 10.0 microgram/cm$^2$; a combination of different RNAi inducing oligonucleotides is applied, which application can be as a mixture or mixtures or separately, e.g., 2, 3, 4, 5, 6, 7, 8, 9, 10, or more different oligonucleotides; one or more different RNAi inducing oligonucleotides (e.g., all targeted to hairless, e.g., siRNA) is applied in combination (as a mixture or separately) with one or more different agents that inhibit hairless translation or hairless activity; one or more different RNAi inducing oligonucleotides is applied in combination with one or more other hair removal agents, such as chemical depilatories and/or enzymatic hair removal agents. In accordance with the preceding description of embodiments, certain of the present pharmaceutical compositions also include at least one hairless inhibiting agent different from an RNAi inducing agent, at least one chemical depilatory; at least one enzymatic hair removal agent.

In certain embodiments, the present RNAi inducing oligonucleotides are applied once; applied daily for at least 7 days; applied daily for at least 14 days; applied on at least 4 days within a one month period; applied on at least 7 days within a one month period; applied at least 4 days per week for at least a four week period.

In particular embodiments, the RNAi inducing oligonucleotide does not include the sequence of a siRNA as shown in the Examples; the RNAi oligonucleotide includes the sequence of an siRNA shown in the Examples and the method of use includes synchronizing hair cycles, e.g., as described herein.

In particular embodiments involving mammalian mRNAs, the RNAi inducing oligonucleotide (e.g., siRNA) includes a sequence 17, 18, 19, 20, 21, 22, 23, 24, or 25 nucleotides in length (or at least one of those lengths) of one of the sequences shown in Table 3, or a sequence complementary thereto; the RNAi inducing oligonucleotide targets a mammalian hairless mRNA sequence corresponding to a sequence shown in Table 3.

In particular embodiments, the RNAi inducing oligonucleotide (e.g., siRNA) targets a human hairless mRNA sequence as identified in Table 4; the RNAi inducing oligonucleotide contains a sequence of 17, 18, 19, 20, 21, 22, 23, 24, 25, 26, 27, 28, 29, or 30 nucleotides in length (or at least one of those lengths).

In particular embodiments, the RNAi inducing oligonucleotide (e.g., siRNA) targets a mouse hairless mRNA sequence as identified in Table 5; the RNAi inducing oligonucleotide contains a sequence of 17, 18, 19, 20, 21, 22, 23, 24, 25, 26, 27, 28, 29, or 30 nucleotides in length (or at least one of those lengths).

Additional embodiments will be apparent from the Detailed Description and from the claims.

BRIEF DESCRIPTION OF THE FIGURES

FIG. 1. NM005144 (SEQ ID NO:11412)
FIG. 2. NM005144.3 (SEQ ID NO: 11413)

DETAILED DESCRIPTION OF THE PREFERRED EMBODIMENTS

The present invention concerns methods for inhibiting hair growth, by inhibiting particular mRNAs using RNAi, e.g., using siRNA. In particular non-limiting embodiments, the present invention provides for siRNA molecules, e.g., double stranded RNA oligonucleotides (which optionally may be chemically modified and/or comprise at least one 3' overhang, as set forth below), comprising a nucleotide sequence that is complementary to a target nucleotide sequence which may be 17, 18, 19, 20, 21, 22, 23, 24 or 25 nucleotides in length, where the siRNA contains a sequence 17, 18, 19, 20, 21, 22, 23, 24, 25, 26, 27, 28, 29 or 30 base pairs in length. Preferably, the hairless in RNA target nucleotide sequence comprises a 17, 18, 19, 20, 21, 22, 23, 24 or 25 nucleotide portion of the human hairless mRNA sequence set forth in FIG. 1 (SEQ ID NO: 11412) and/or FIG. 2 (SEQ ID NO: 11413). Non-limiting examples of target sequences may be identified as loops identified in secondary mRNA structure using software designed for such purpose (e.g. RnaDraw, RnaMotif, Rnaview-RnaMLView, RnaViz, Vienna RNA Package, etc.).

A. RNAi and siRNA

RNA interference (RNAi) refers to the process of sequence-specific post-transcriptional gene silencing in animals mediated by short interfering RNAs (siRNAs) (Fire et al., 1998, *Nature*, 391, 806). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., 1999, *Trends Genet.*, 15, 358). The presence of dsRNA in cells triggers the RNAi response though a mechanism that appears to be different from the interferon response that results from dsRNA-mediated activation of protein kinase PKR and 2',5'-oligoadenylate synthetase resulting in non-specific cleavage of mRNA by ribonuclease L.

The presence of long dsRNAs in cells stimulates the activity of the enzyme, dicer, a ribonuclease III. Dicer is involved in the processing of the dsRNA into short pieces of dsRNA known as short interfering RNAs (siRNAs) (Berstein et al., 2001, *Nature*, 409, 363). The resulting RNAs are typically about 21 to about 23 nucleotides in length, with complementary sequences of about 19 base pairs. Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also involves an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, *Genes Dev.*, 15, 188).

RNAi has been studied in a variety of systems. Fire et al., 1998, *Nature*, 391, 806, described RNAi in *C. elegans*. Wianny and Goetz, 1999, *Nature Cell Biol.*, 2, 70, describe RNAi mediated by dsRNA in mouse embryos. Hammond et al., 2000, *Nature*, 404, 293, describe RNAi in *Drosophila* cells transfected with dsRNA. Elbashir et al., 2001, *Nature*, 411, 494, describe RNAi induced by introduction of duplexes of synthetic 21-nucleotide RNAs in cultured mammalian cells including human embryonic kidney and HeLa cells.

Work in *Drosophila* embryonic lysates (Elbashir et al., 2001, *EMBO J*, 20, 6877) has revealed certain factors of siRNA length, structure, chemical composition, and sequence that are significantly affect efficient RNAi activity. These studies have shown that 21-nucleotide siRNA duplexes are most active when containing 3'-terminal nucleotide overhangs. Furthermore, complete substitution of one or both siRNA strands with 2'-deoxy (2'-H) or 2'-O-methyl nucleotides abolishes RNAi activity, whereas substitution of the 3'-terminal siRNA overhang nucleotides with 2'-deoxy nucleotides (2'-H) was shown to be tolerated. Single mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end of the guide sequence (Elbashir et al., 2001, *EMBO J.*, 20, 6877). Other studies have suggested that a 5'-phosphate on the target-complementary strand of a siRNA duplex is important for siRNA activity and that ATP is utilized to maintain the 5'-phosphate moiety on the siRNA (Nykanen et al., 2001, *Cell*, 107, 309).

Studies have shown that replacing the 3'-terminal nucleotide overhanging segments of a 21-mer siRNA duplex having two 2-nucleotide 3'-overhangs with deoxyribonucleotides does not have an adverse effect on RNAi activity. Replacing up to 4 nucleotides on each end of the siRNA with deoxyribonucleotides has been reported to be well-tolerated whereas complete substitution with deoxyribonucleotides results in no RNAi activity, but that substitution of siRNA with 2'-O-methyl nucleotides completely abolishes RNAi activity. (Elbashir et al., 2001, *EMBO J.*, 20, 6877.)

Li et al., International PCT Publication No. WO 00/44914, and Beach et al., International PCT Publication No. WO 01/68836 both suggest that siRNA "may include modifications to either the phosphate-sugar backbone or the nucleoside . . . to include at least one of a nitrogen or sulfur heteroatom."

Kreutzer and Limmer, Canadian Patent Application No. 2,359,180, also describe certain chemical modifications for use in dsRNA constructs in order to counteract activation of double-stranded RNA-dependent protein kinase PKR, specifically 2'-amino or 2'-O-methyl nucleotides, and nucleotides containing a 2'-O or 4'-C methylene bridge Parrish et al., 2000, *Molecular Cell*, 6, 1977-1087, tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that "RNAs with two [phosphorothioate] modified bases also had substantial decreases in effectiveness as RNAi triggers (data not shown); [phosphorothioate] modification of more than two residues greatly destabilized the RNAs in vitro and we were not able to assay interference activities." Id. at 1081. The authors also tested certain modifications at the 2'-position of the nucleotide sugar in the long siRNA transcripts and observed that substituting deoxynucleotides for ribonucleotides "produced a substantial decrease in interference activity," especially in the case of Uridine to Thymidine and/or Cytidine to deoxy-Cytidine substitutions. Id. In addition, the authors tested certain base modifications, including substituting, in sense and antisense strands of the siRNA, 4-thiouracil, 5-bromouracil, 5-iodouracil, and 3-(aminoallyl)uracil for uracil, and inosine for guanosine. They found that whereas 4-thiouracil and 5-bromouracil were all well-tolerated, inosine "produced a substantial decrease in interference activity" when incorporated in either strand. Incorporation of 5-iodouracil and 3-(aminoallyl)uracil in the antisense strand resulted in substantial decrease in RNAi activity as well.

Beach et al., International PCT Publication No. WO 01/68836, describes specific methods for attenuating gene expression using endogenously-derived dsRNA.

Tuschl et al., International PCT Publication No. WO 01/75164, describe a *Drosophila* in vitro RNAi system and the use of specific siRNA molecules for certain functional genomic and certain therapeutic applications; although Tuschl, 2001, *Chem. Biochem.*, 2, 239-245, doubts that RNAi can be used to cure genetic diseases or viral infection due "to the danger of activating interferon response."

Li et al., International PCT Publication No. WO 00/44914, describe the use of specific dsRNAs for use in attenuating the expression of certain target genes.

Zernicka-Goetz et al., International PCT Publication No. WO 01/36646, describe certain methods for inhibiting the expression of particular genes in mammalian cells using certain dsRNA molecules.

Fire et al., International PCT Publication No. WO 99/32619, describe particular methods for introducing certain dsRNA molecules into cells for use in inhibiting gene expression.

Plaetinck et al., International PCT Publication No. WO 00/01846, describe certain methods for identifying specific genes responsible for conferring a particular phenotype in a cell using specific dsRNA molecules.

Mello et al., International PCT Publication No. WO 01/29058, describe the identification of specific genes involved in dsRNA-mediated RNAi.

Deschamps Depaillette et al., International PCT Publication No. WO 99/07409, describe specific compositions consisting of particular dsRNA molecules combined with certain anti-viral agents.

Waterhouse et al., International PCT Publication No. 99/53050, describe certain methods for decreasing the phenotypic expression of a nucleic acid in plant cells.

Driscoll et al., International PCT Publication No. WO 01/49844, describe specific DNA constructs for use in facilitating gene silencing in targeted organisms.

Parrish et al., 2000, *Molecular Cell*, 6, 1977-1087, describe specific chemically-modified siRNA constructs targeting the unc-22 gene of *C. elegans*.

Grossniklaus, International PCT Publication No. WO 01/38551, describes certain methods for regulating polycomb gene expression in plants.

Churikov et al., International PCT Publication No. WO 01/42443, describe certain methods for modifying genetic characteristics of an organism.

Cogoni et al., International PCT Publication No. WO 01/53475, describe certain methods for isolating a *Neurospora* silencing gene and uses thereof.

Reed et al., International PCT Publication No. WO 01/68836, describe certain methods for gene silencing in plants.

Honer et al., International PCT Publication No. WO 01/70944, describe certain methods of drug screening using transgenic nematodes as Parkinson's Disease models.

Deak et al., International PCT Publication No. WO 01/72774, describe certain *Drosophila*-derived gene products.

Arndt et al., International PCT Publication No. WO 01/92513, describe certain methods for mediating gene suppression by using factors that enhance RNAi.

Tuschl et al., International PCT Publication No. WO 02/44321, describe certain synthetic siRNA constructs.

Pachuk et al., International PCT Publication No. WO 00/63364, and Satishchandran et al., International PCT Publication No. WO 01/04313, describe certain methods and compositions for inhibiting the function of certain oligonucleotide sequences.

Echeverri et al., International PCT Publication No. WO 02/38805, describe certain *C. elegans* genes identified via RNAi.

Kreutzer et al., International PCT Publications Nos. WO 02/055692, WO 02/055693, and EP 1144623 B1 describes certain methods for inhibiting gene expression using RNAi.

Graham et al., International PCT Publications Nos. WO 99/49029 and WO 01/70949, and AU 4037501 describe certain vector expressed long double stranded RNA molecules.

McSwiggen et al., PCT/US03/05028, WO 03/074654 describes RNA interference mediated inhibition of gene expression using short interfering nucleic acid (siNA), and provides a table listing thousands of mRNAs, which is believed to include hairless protein mRNA, as potential targets for such siNA.

McSwiggen et al., PCT/US03/05346, WO 03/070918 describes synthetic chemically modified small nucleic acid molecules capable of mediating RNA interference against target nucleic acid sequences. The reference reports that up to all of the nucleotides in the RNA strands can be replaced with moieties that are not ribonucleotides.

B. Hairless Protein mRNA

Applicant's have found that RNAi can be used to inhibit translation from hairless protein mRNA, resulting in hair removal. This hair removal is long term, or even permanent, thus providing cosmetic and therapeutic methods, as well as methods useful for laboratory experimental mammals, and for de-hairing in the leather industry.

The Hairless Protein gene is expressed during a narrow window during the hair cycle, just at the transition to catagen (the regression phase). (Panteleyev et al. 1998, *Exp Dermatol.* 7:249-67; Panteleyev et al. 2000, *Am J Pathol.* 157:1071-9). In both humans and mice with mutations in the hairless gene, the cardinal finding is a wave of hair shedding shortly after birth, and no subsequent hair growth throughout life. The phenotype results from permanent structural damage to the hair follicle, after which no further hair cycling can occur. In addition, humans and mice which are genetically deficient in hairless gene expression exhibit no other phenotypic manifestations or abnormalities that might be associated with a deleterious effect (Zlotogorski et al., 2002, *J Invest Dermatol.* 118:887-90), suggesting that hairless is specifically involved and indispensable in regulating the hair cycle, and that its functions elsewhere in the body (if any) are compensated by other factors.

As a result, hair removal using RNAi targeted to hairless mRNA provides an advantageous approach, as any inadvertent, non-localized inhibition of hairless mRNA will not adversely affect the subject.

C. Applications and Conditions to be Treated

As indicated above, the present invention concerns inhibition of hair growth, and consequent hair removal, and is applicable to a number of different therapeutic, cosmetic, and industrial applications. The methods can be readily adapted to any of the various mammals having hairless protein analogs, for example, human, mouse, rat, cattle (and other bovines), equines.

1. Long Term (Permanent) Hair Removal

Permanent, or at least long term, hair removal can involve inhibition of hairless protein. Such hair removal is useful for both cosmetic and therapeutic applications. Exemplary cosmetic applications can include, for example, back and chest hair for men and upper lip, eyebrow, leg, arm, underarm, and pubic hair for women.

In addition to cosmetic applications, permanent or long term hair removal is also useful in certain conditions, e.g., trachoma, the various forms of hypertrichosis, and hirsutism.

Hypertrichosis

Hypertrichosis describes all forms of hair growth that are excessive for the bodily location and age of an individual, and which do not result from androgen stimulation. The present invention can be used for the various forms and causes of hypertrichosis, e.g., those described herein.

Hypertrichosis is usually categorized on the basis of the age of onset (at birth or during later years), the extent of distribution (universal or localized), the site of involvement (elbows, anterior or posterior neck), and the cause (genetic or acquired).

Acquired hypertrichosis may result from the use of particular drugs, for example, oral minoxidil, phenyloin, and cyclosporin. Acquired hypertrichosis lanuginosa may also be a manifestation of an underlying malignancy. In the dermatological literature, this is known as "malignant down". Additional causes of acquired hypertrichosis include hormonal imbalances, malnutrition, HIV and local inflammation.

In addition, some forms of hypertrichosis are clearly hereditary but the genes involved generally remain unknown. Genetic forms of hypertrichosis are very rare human disorders.

There are only a small number of human disorders that have generalized congenital hypertrichosis as the leading phenotypic feature. These include:

Hypertrichosis universalis (MIM145700)
Hypertrichosis universalis congenita, Ambras type (MIM145701)
Gingival fibromatosis with hypertrichosis (MIMI 35400)
Barber-Say syndrome (MIM209885)
Amaurosis congenita, cone-rod type, with hypertrichosis (MIM204110),
CAHMR syndrome (MIM21770)
Cantu syndrome (MIM239850)
Gingival fibromatosis with hypertrichosis and mental retardation MIM605400)
X-linked hypertrichosis (MIM307150)
Acromegaly and hypertrichosis (Irvine et al, 1996).

Of these, only Hypertrichosis universalis, Ambras type hypertrichosis, and X-linked hypertrichosis have excessive hair as the predominant feature. In all the other listed syndromes hypertrichosis is associated with additional more prominent abnormalities. The present invention can be used to treat hypertrichosis, e.g., in any of the conditions listed above, as well as in other conditions in which trichosis occurs.

Trachoma

Trachoma is the leading cause of blindness worldwide. The World Health Organization estimates that there are 146 million people with trachoma and that the disease has caused blindness in 5.9 million people, 15% of the world's blindness. Trachoma is caused by the gram-negative bacterium *Chlamydia trachomatis*, an intracellular parasite transmitted by fly infestation. In trachoma, the conjunctival lining of the eyelids becomes infected with the bacterium, which over the long term, causes an inflammatory response. The inflammation can lead to scarring, shortening of the lid and in-turning of the eyelashes. Trichiasis, the condition when eyelashes rub on the cornea, can lead to blindness. An estimated 10.6 million adults have inturned eyelashes that require surgery.

While it is advantageous of the *Chlamydia* infection is prevented, or treated before in-turning of the eyelashes, there is a need for non-surgical approaches to treatment that can at least reduce the corneal scarring. Thus, removal of the eyelash hairs (without leaving stubble) using the present invention can substantially slow, or even prevent such corneal damage, thereby preserving the individual's vision.

Trichiasis

In addition to trachoma, in-turned eyelashes (trichiasis) can have other causes, and are a common source of recurrent ocular irritation for some patients. The in-turned lash (or lashes) in contact with the conjunctiva and/or cornea may lead to a foreign body sensation, localized conjunctival injection, pain and photophobia.

Trichiasis is the term used for misdirection or aberrant placement of eyelashes along the eyelid margin resulting in lash growth toward the cornea. Trichiasis is an acquired condition that may be caused by the following inflammatory or traumatic processes involving the eyelids. The present invention can be used in all cases of trichiasis, including those in the following causal situations:

Chronic blepharitis with meibomianitis—chronic inflammatory changes within the tarsal plate and posterior eyelid margin may cause destruction and misdirection of lash follicles, resulting in chronic trichiasis.

Lid lacerations and thermal burns to the lid margin—may cause redirection of the lash roots with resultant trichiasis.

Previous surgery on eyelids—For example, lid adhesions (tarsorrhaphys) done to prevent exposure in some patients with seventh nerve palsies may cause misdirection of lashes. Similarly, in many reconstructive eyelid procedures, the new eyelid margin may contain fine skin hairs (lanugo-type) that rub on the cornea.

Mucocutaneous diseases—Stevens-Johnson syndrome and Ocular Cicatricial Pemphigoid result not only in the destruction of the eyelid margins and trichiasis but also in the formation of new lashes from the meibomian gland orifices (a condition referred to as distichiasis).

Other cicatricial conjunctival diseases—Herpes Simplex conjunctivitis and Herpes Zoster may cause a cicatrizing conjunctivitis with destruction of the lid margin and lash follicles. Trachoma may also cause a chronic tarsitis with cicatrizing conjunctivitis in the upper or lower eyelid and resultant trichiasis (as well as a cicatricial entropion).

Irradiation and chemical burns—Therapeutic irradiation for eyelid cancers or alkali burns may lead to a disruption of the normal eyelid margin anatomy and resultant misdirection of eyelashes. Both of these processes may also lead to metaplasia of squamous epithelium of the mucocutaneous margin of the eyelid with resultant keratinization, a source of ocular irritation. In addition, destruction of the goblet cells, accessory lacrimal glands, and lacrimal gland will disrupt the normal tear flow, compounding the above problems.

Other conditions in which eyelashes contact the cornea also exist, and the present invention can be used in those cases also. For example:

A condition similar to trichiasis is Eyelid entropion—True entropion (e.g. involutional type seen in the aging population) is characterized by a normal eyelid margin architecture: the eyelid inverts as a result of eyelid laxity, allowing the eyelashes to rub on the cornea. Several of the entities mentioned above (Ocular Pemphigoid, Stevens-Johnson Syndrome) may cause a cicatrization of the conjunctiva as well as the lid margin and create a cicatricial entropion with trichiasis (i.e. the eyelid is inverted due to a cicatricial process). In addition, eyelashes may be misdirected not only due to the lid position, but also due to the inflammatory process involving the actual lash follicles. Therefore, sometimes there may be two problems present (entropion and trichiasis) both of which may require treatment.

Epiblepharon—Epiblepharon is a congenital condition commonly seen in the lower Asian eyelid. A fold of skin and muscle roll upwards and presses the lashes toward the cornea. This does not represent true trichiasis.

Distichiasis—is an abnormality in which an aberrant second row of lashes, (usually from the meibomian gland orifices) grows behind the normal lash line. It may be congenital or acquired. Any process causing chronic inflammation of the lid margin and meibomian glands may transform the meibomian glands into pilosebaceous units capable of producing hair (e.g. chronic blepharitis).

Combined eyelid margin process—Several of the eyelid processes mentioned (Stevens-Johnson syndrome, Ocular Pemphigoid, irradiation, chemical burns) not only may cause entropion and trichiasis, but in addition may lead to squamous metaplasia and keratinization of the non-keratinizing squamous epithelium of the eyelid margin. Keratinized tissue is very irritating to the eye. Therefore, several factors may contribute to the ocular irritation, and as a result, several types of treatment could be required.

Marginal entropion—Is a subtle form of entropion that is seen only at the lid margin. Usually there is chronic inflammation at the eyelid margin with a mild cicatricial process that is starting to roll the lid margin inward. The eyelashes appear more vertical with some truly trichiatic lashes. The clinical clue is the meibomian gland orifices. Normally they should be vertical and not covered by conjunctival epithelium. If the openings are rolled inward and conjunctiva is growing over the opening, then marginal entropion is present in addition to trichiasis. It is important to distinguish this condition when considering treatment.

Hirsutism

Hirsutism is excessive hair growth on a female in a male growth pattern, typically excessive facial hair. Hirsutism is usually caused by an increased sensitivity of the skin to a group of hormones called androgens (testosterone and androstenedione) or increased production of these hormones. Androgen disorders (hyperandrogenism) affects between 5% to 10% of all women. Hair from this condition can be removed in full or part using the present invention.

Pseudofolliculitis barbae

Pseudofolliculitis barbae (razor bumps) is a common condition of the beard area occurring in African American men and other people with curly hair. The problem results when highly curved hairs grow back into the skin causing inflammation and a foreign body reaction. Over time, this can cause keloidal scarring which looks like hard bumps of the beard area and neck. Currently this is usually addressed by attempting to prevent the hair from curving back and growing into the skin with altered shaving practices and the like. The present invention can be used to eliminate hairs causing such difficulties.

Experimental Animals

Permanent hair removal as described herein can also be used with experimental animals to remove hair from all or a portion of the body of an experimental animal. Thus, for example, a hairless spot can be created on a mouse, rat, sheep, monkey, chimpanzee, rabbit or other animal for application over an extended period of time of topically applied pharmaceutical compounds or other materials. Thus, the present invention can be used for this purpose, either with or without shaving shaveing, waxing, or depilation, or other such treatment. In some cases, the hairless spot or area on the animal is initially created with shaving, waxing, or other hair removal method, and the present invention allows the bare area to be maintained (which may be after a sustained period of application of the present compositions, e.g., at least 2, 4, 7, or 10 days, or 2, 3, 4, 5, 6, 8, 10, 12, weeks or even longer).

Industrial Applications

In addition, permanent hair removal as described herein can also be useful to remove hair from mammals whose hides will be used for leather. Dehairing is one of the main initial steps in leather production. Five methods of dehairing are commonly used: i.e., (i) clipping process, (ii) scalding process, (iii) chemical process, (iv) sweating process, and (v) enzymatic process. Of these, the most commonly practiced method of dehairing of hides and skins is the chemical process using lime and sodium sulphide. However, the use of high concentrations of lime and sodium sulphide creates an extremely alkaline environment resulting in the pulping of hair and its subsequent removal, and presents substantial pollution problems. Thus, removal of hairs using the present invention allows hides to be prepared for leather production while eliminating or at least reducing the use of the pollution-causing methods.

D. Use of RNAi and Oligo Sequences

The use of RNAi to reduce or eliminate translation from a targeted mRNA has been described in a number of patents and published patent applications, e.g., as mentioned in the Background of the Invention. In the present invention, particular target sites in hairless protein mRNA can be identified experimentally and/or using software programs to identify accessible sites. For example, procedures such as those described below can be used to identify sites, and to select an optimal site and active oligonucleotide.

Identification of Potential RNAi (e.g., siRNA) Target Sites in any RNA Sequence

The sequence of an RNA target of interest, such as a viral or human mRNA transcript, is screened for target sites, for example by using a computer folding algorithm. In a non-limiting example, the sequence of a gene or RNA gene transcript derived from a database, such as Genbank, is used to generate siNA targets having complementarity to the target. Such sequences can be obtained from a database, or can be determined experimentally as known in the art. Target sites that are known, for example, those target sites determined to be effective target sites based on studies with other nucleic acid molecules, for example ribozymes or antisense, or those targets known to be associated with a disease or condition such as those sites containing mutations or deletions, can be used to design siNA molecules targeting those sites as well. Various parameters can be used to determine which sites are the most suitable target sites within the target RNA sequence. These parameters include but are not limited to secondary or tertiary RNA structure, the nucleotide base composition of the target sequence, the degree of homology between various regions of the target sequence, or the relative position of the target sequence within the RNA transcript. Based on these determinations, any number of target sites within the RNA transcript can be chosen to screen siNA molecules for efficacy, for example by using in vitro RNA cleavage assays, cell culture, or animal models. In a non-limiting example, anywhere from 1 to 1000 target sites are chosen within the transcript based on the size of the siNA construct to be used. High throughput screening assays can be developed for screening siNA molecules using methods known in the art, such as with multi-well or multi-plate assays or combinatorial/siNA library screening assays to determine efficient reduction in target gene expression.

Selection of siNA Molecule Target Sites in a RNA

The following non-limiting steps can be used to carry out the selection of siNAs targeting a given gene sequence or transcript.

1 The target sequence is parsed in silico into a list of all fragments or subsequences of a particular length, for example 23 nucleotide fragments, contained within the target sequence. This step is typically carried out using a custom Perl script, but commercial sequence analysis programs such as Oligo, MacVector, or the GCG Wisconsin Package can be employed as well.

2 In some instances the siNAs correspond to more than one target sequence; such would be the case for example in targeting different transcripts of the same gene, targeting different transcripts of more than one gene, or for targeting both the human gene and an animal homolog. In this case, a subsequence list of a particular length is generated for each of the targets, and then the lists are compared to find matching sequences in each list. The subsequences are then ranked according to the number of target sequences that contain the given subsequence; the goal is to find subsequences that are present in most or all of the target sequences. Alternately, the ranking can identify subsequences that are unique to a target sequence, such as a mutant target sequence. Such an approach would enable the use of siNA to target specifically the mutant sequence and not effect the expression of the normal sequence.

3 In some instances the siNA subsequences are absent in one or more sequences while present in the desired target sequence; such would be the case if the siNA targets a gene with a paralogous family member that is to remain untargeted. As in case 2 above, a subsequence list of a particular length is generated for each of the targets, and then the lists are compared to find sequences that are present in the target gene but are absent in the untargeted paralog.

4 The ranked siNA subsequences can be further analyzed and ranked according to GC content. A preference can be given to sites containing 30-70% GC, with a further preference to sites containing 40-60% GC.

5 The ranked siNA subsequences can be further analyzed and ranked according to self-folding and internal hairpins. Weaker internal folds are preferred; strong hairpin structures are to be avoided.

6 The ranked siNA subsequences can be further analyzed and ranked according to whether they have runs of GGG or CCC in the sequence. GGG (or even more Gs) in either strand can make oligonucleotide synthesis problematic and can potentially interfere with RNAi activity, so it is avoided whenever better sequences are available. CCC is searched in the target strand because that will place GGG in the antisense strand.

7 The ranked siNA subsequences can be further analyzed and ranked according to whether they have the dinucleotide UU (uridine dinucleotide) on the 3'-end of the sequence, and/or AA on the 5'-end of the sequence (to yield 3' UU on the antisense sequence). These sequences allow one to design siNA molecules with terminal TT thymidine dinucleotides.

8 Four or five target sites are chosen from the ranked list of subsequences as described above. For example, in subsequences having 23 nucleotides, the right 21 nucleotides of each chosen 23-mer subsequence are then designed and synthesized for the upper (sense) strand of the siNA duplex, while the reverse complement of the left 21 nucleotides of each chosen 23-mer subsequence are then designed and synthesized for the lower (antisense) strand of the siNA duplex. If terminal TT residues are desired for the sequence (as described in paragraph 7), then the two 3' terminal nucleotides of both the sense and antisense strands are replaced by TT prior to synthesizing the oligos.

9 The siNA molecules are screened in an in vitro, cell culture or animal model system to identify the most active siNA molecule or the most preferred target site within the target RNA sequence.

In an alternate approach, a pool of siNA constructs specific to a target sequence is used to screen for target sites in cells expressing target RNA, such as human lung HeLa cells. A non-limiting example of such as pool is a pool comprising sequences having antisense sequences complementary to the target RNA sequence and sense sequences complementary to the antisense sequences. Cells (e.g., HeLa cells) expressing the target gene are transfected with the pool of siNA constructs and cells that demonstrate a phenotype associated with gene silencing are sorted. The pool of siNA constructs can be chemically modified as described herein and synthesized, for example, in a high throughput manner. The siNA from cells demonstrating a positive phenotypic change (e.g., decreased target mRNA levels or target protein expression), are identified, for example by positional analysis within the assay, and are used to determine the most suitable target site(s) within the target RNA sequence based upon the complementary sequence to the corresponding siNA antisense strand identified in the assay.

Exemplary siNA Design siNA target sites are chosen by analyzing sequences of the target RNA target and optionally prioritizing the target sites on the basis of folding (structure of any given sequence analyzed to determine siNA accessibility to the target), by using a library of siNA molecules as described, or alternately by using an in vitro siNA system as described herein. siNA molecules were designed that could bind each target and are optionally individually analyzed by computer folding to assess whether the siNA molecule can interact with the target sequence. Varying the length of the siNA molecules can be chosen to optimize activity. Generally, a sufficient number of complementary nucleotide bases are chosen to bind to, or otherwise interact with, the target RNA, but the degree of complementarity can be modulated to accommodate siNA duplexes or varying length or base composition. By using such methodologies, siNA molecules can be designed to target sites within any known RNA sequence, for example those RNA sequences corresponding to the any gene transcript.

Chemically modified siNA constructs are designed to provide nuclease stability for systemic administration in vivo and/or improved pharmacokinetic, localization, and delivery properties while preserving the ability to mediate RNAi activity. Chemical modifications as described herein are introduced synthetically using synthetic methods described herein and those generally known in the art. The synthetic siNA constructs are then assayed for nuclease stability in serum and/or cellular/tissue extracts (e.g. liver extracts). The synthetic siNA constructs are also tested in parallel for RNAi activity using an appropriate assay, such as a luciferase reporter assay as described herein or another suitable assay that can quantity RNAi activity. Synthetic siNA constructs that possess both nuclease stability and RNAi activity can be further modified and re-evaluated in stability and activity assays. The chemical modifications of the stabilized active siNA constructs can then be applied to any siNA sequence targeting any chosen RNA and used, for example, in target screening assays to pick lead siNA compounds for therapeutic development.

RNAi In Vitro Assay to Assess siNA Activity

An in vitro assay that recapitulates RNAi in a cell free system is used to evaluate siNA constructs specific to target RNA. The assay comprises the system described by Tuschl et al., 1999, Genes and Development, 13, 3191-3197 and Zamore et al., 2000, Cell, 101, 25-33 adapted for use with a specific target RNA. A Drosophila extract derived from syncytial blastoderm is used to reconstitute RNAi activity in vitro. Target RNA is generated via in vitro transcription from an appropriate plasmid using T7 RNA polymerase or via chemical synthesis as described herein. Sense and antisense siNA strands (for example 20 uM each) are annealed by incubation in buffer (such as 100 mM potassium acetate, 30 mM HEPES-KOH, pH 7.4, 2 mM magnesium acetate) for 1 min. at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two hour old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing siNA (10 nM final concentration). The reaction mixture also contains 10 mM creatine phosphate, 10 ug.ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which siNA is omitted from the reaction.

Alternately, internally-labeled target RNA for the assay is prepared by in vitro transcription in the presence of $[a-^{32}P]$ CTP, passed over a G 50 Sephadex column by spin chromatography and used as target RNA without further purification. Optionally, target RNA is 5'-$^{32}$P-end labeled using T4 oligonucleotide kinase enzyme. Assays are performed as described above and target RNA and the specific RNA cleavage products generated by RNAi are visualized on an autoradiograph of a gel. The percentage of cleavage is determined by Phosphor Imager® quantitation of bands representing intact control RNA or RNA from control reactions without siNA and the cleavage products generated by the assay.

In one embodiment, this assay is used to determine target sites in the RNA target for siNA mediated RNAi cleavage, wherein a plurality of siNA constructs are screened for RNAi mediated cleavage of the RNA target, for example by analyzing the assay reaction by electrophoresis of labeled target RNA, or by northern blotting, as well as by other methodology well known in the art.

Specific hairless protein target sequences and the complementary sequences are provided as 19-mers in Table 1 following the Examples. In the table, the oligo number (first column on the left), e.g., 1, 2, 3, etc. matches the $1^{st}$ (5') nucleotide in the reference sense cDNA sequence. Thus, Oligonucleotide 1 begins at nucleotide 1 in the reference hairless cDNA sequence, Oligonucleotide 2, begins at nucleotide 2 in the reference sequence, and so on. Thus, one skilled in the art recognizes that the nucleotide position of each nucleotide in each oligonucleotide in Table 1 is specified as if each nucleotide were marked with the respective number.

The sequences shown in Table 1 are provided as DNA sequences, but one skilled in the art understands that Table 1 also describes the matching RNA sequence. One skilled in the art understands that the RNA sequence has a U replacing each T shown in the DNA sequence. For example, for Oligonucleotide 1 in Table 1, the DNA sequence is 5'-TCTCCCGG-GAGCCACTCCC-3' (SEQ ID NO: 1), and the matching RNA sequence is 5'-UCUCCCGGGAGCCACUCCC-3' (SEQ ID NO: 11332).

While oligonucleotides are shown in Table 1 as 19-mers, this description expressly includes the additional 20-mer, 21-mer, 22-mer, 23-mer, 24-mer, 25-mer, 26-mer, 27-mer, 28-mer, and 29-mer oligonucleotides as if they were included in the table. The sequence descriptions of those 20-29-mers is provided by taking a starting 19-mer that has the same 5'-nucleotide as the respective 20-29-mer, and adding the next 1, 2, 3, 4, 5, 6, 7, 8, 9, or 10 3'-nucleotides from the subsequent 19-mer oligonucleotides from the table. Thus, for example, the 19-mer sense RNA Oligonucleotide 4 has the sequence:

5'-CCCGGGAGCCACUCCCAUG-3'    (SEQ ID NO: 11333)

and the complementary 19-mer RNA described has the sequence

5'-CAUGGGAGUGGCUCCCGGG-3'.    (SEQ ID NO: 11334)

Further, a 20-mer RNA that includes the Oligonucleotide 4 sequence is described by the Oligo 4 sequence with the next nucleotide 3', i.e., the 3'-terminal G from Oligo 5. Thus, the 20-mer RNA described has the sequence

5'-CCCGGGAGCCACUCCCAUGG-3'    (SEQ ID NO: 11335)

and the complementary 20-mer RNA described has the sequence

5'-CCAUGGGAGUGGCUCCCGGG-3'.    (SEQ ID NO: 11336)

Similarly, a 21-mer RNA that includes the Oligonucleotide 4 sequence is described by the Oligo 4 sequence with the next two nucleotides 3', i.e., the 3'-terminal GG from Oligo 6. Thus, the 21-mer RNA described has the sequence

5'-CCCGGGAGCCACUCCCAUGGG-3'    (SEQ ID NO: 11337)

and the complementary 21-mer RNA described has the sequence

5'-CCCAUGGGAGUGGCUCCCGGG-3'.    (SEQ ID NO: 11338)

As the next oligonucleotide described, a 22-mer RNA that includes the Oligonucleotide 4 sequence is described by the Oligo 4 sequence with the next three nucleotides 3', i.e., the 3'-terminal GGC from Oligo 7. Thus, the 22-mer RNA described has the sequence

5'-CCCGGGAGCCACUCCCAUGGGC-3'    ((SEQ ID NO: 11339)

and the complementary 22-mer RNA described has the sequence

5'-GCCCAUGGGAGUGGCUCCCGGG-3'.    (SEQ ID NO: 11340)

A 23-mer RNA that includes the Oligonucleotide 4 sequence is described by the Oligo 4 sequence with the next four nucleotides 3', i.e., the 3'-terminal GGCG from Oligo 8. Thus, the 23-mer RNA described has the sequence

5'-CCCGGGAGCCACUCCCAUGGGCG-3'    (SEQ ID NO: 11341)

and the complementary 23-mer RNA described has the sequence

5'-CGCCCAUGGGAGUGGCUCCCGGG-3'.    (SEQ ID NO: 11342)

A 24-mer RNA that includes the Oligonucleotide 4 sequence is described by the Oligo 4 sequence with the next five nucleotides 3', i.e., the 3'-terminal GGCGC from Oligo 9. Thus, the 24-mer RNA described has the sequence

5'-CCCGGGAGCCACUCCCAUGGGCGC-3'    (SEQ ID NO: 11343)

and the complementary 24-mer RNA described has the sequence

5'-GCGCCCAUGGGAGUGGCUCCCGGG-3'.    (SEQ ID NO: 11344)

In similar fashion, a 25-mer that includes the Oligonucleotide 4 sequence is described as

5'-CCCGGGAGCCACUCCCAUGGGCGCC-3'    (SEQ ID NO: 11345)

and the complementary 25-mer RNA described has the sequence

5'-GGCGCCCAUGGGAGUGGCUCCCGGG-3'.    (SEQ ID NO: 11346)

A 26-mer that includes the Oligonucleotide 4 sequence is described as

5'-CCCGGGAGCCACUCCCAUGGGCGCCU-3'    (SEQ ID NO: 11347)

and the complementary 26-mer RNA described has the sequence (SEQ ID NO: 11348)
5'-AGGCGCCCAUGGGAGUGGCUCCCGGG-3'.

A 27-mer that includes the Oligonucleotide 4 sequence is described as (SEQ ID NO: 11349)
5'-CCCGGGAGCCACUCCCAUGGGCGCCUC-3' and the complementary 27-mer RNA described has the sequence (SEQ ID NO: 11350)
5'-GAGGCGCCCAUGGGAGUGGCUCCCGGG-3'.

A 28-mer that includes the Oligonucleotide 4 sequence is described as (SEQ ID NO: 11351)
5'-CCCGGGAGCCACUCCCAUGGGCGCCUCU-3' and the complementary 28-mer RNA described has the sequence (SEQ ID NO: 11352)
5'-AGAGGCGCCCAUGGGAGUGGCUCCCGGG-3'.

A 29-mer that includes the Oligonucleotide 4 sequence is described as (SEQ ID NO: 11353)
5'-CCCGGGAGCCACUCCCAUGGGCGCCUCUC-3' and the complementary 29-mer RNA described has the sequence (SEQ ID NO: 11354)
5'-GAGAGGCGCCCAUGGGAGUGGCUCCCGGG-3'.

Thus, Table 1 describes each of the 19-mers shown in Table 1 as DNA and RNA, and the corresponding 20-mers and longer.

In addition, the Table describes double stranded oligonucleotides with the sense and antisense oligonucleotide strands hybridized, as well as such double stranded oligonucleotides with one or both strands having a 3'-overhang. Such an overhang consists of one or more 3'-terminal nucleotides of an oligonucleotide strand in a double stranded molecule that are not hybridized with the complementary strand. In the present case, such overhang nucleotides often match the corresponding nucleotides from the target mRNA sequence, but can be different.

Table 1 also describes oligonucleotides that contain known polymorphisms. Those polymorphic sites are described in Table 2 along with the replacement nucleotide. Thus, Table 1 with Table 2 describes the oligonucleotides with the alternate nucleotides at a polymorphic site.

Chemical Modifications

As indicated above, for many applications it is advantageous to use chemically modified oligonucleotides rather than unmodified RNA for RNAi (e.g., siRNA). Such modification can dramatically increase the cellular and/or serum lifetime of the modified oligonucleotide compared to the unmodified form.

Description of such chemical modification is provided in McSwiggen et al., PCT/US03/05346, WO 03/070918. Thus, the introduction of chemically modified nucleotides into nucleic acid molecules assists in overcoming potential limitations of in vivo stability and bioavailability inherent to native RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum. Furthermore, certain chemical modifications can improve the bioavailability of nucleic acid molecules by targeting particular cells or tissues and/or improving cellular uptake of the nucleic acid molecule. Therefore, even if the activity of a chemically modified nucleic acid molecule is reduced as compared to a native nucleic acid molecule, for example when compared to an all RNA nucleic acid molecule, the overall activity of the modified nucleic acid molecule can be greater than the native molecule due to improved stability and/or delivery of the molecule. Unlike native unmodified siRNA, chemically modified siNA can also minimize the possibility of activating interferon activity in humans.

Thus, in some embodiments of the present invention, the nucleic acid molecules that act as mediators of the RNA interference gene silencing response are chemically modified double stranded nucleic acid molecules, generally about 19-29 nucleotides in length. The most active siRNA molecules are thought to have such duplexes with overhanging ends of 1-3 nucleotides, for example 21 nucleotide duplexes with 19 base pairs and 2 nucleotide 3'-overhangs. These overhanging segments are readily hydrolyzed by endonucleases in vivo. Studies have shown that replacing the 3'-overhanging segments of a 21-mer siRNA duplex having 2 nucleotide 3' overhangs with deoxyribonucleotides does not have an adverse effect on RNAi activity. Replacing up to 4 nucleotides on each end of the siRNA with deoxyribonucleotides has been reported to be well tolerated whereas complete substitution with deoxyribonucleotides results in no RNAi activity (Elbashir et al., 2001, *EMBO J.*, 20, 6877). In addition, Elbashir et al. also report that full substitution of siRNA with 2'-O-methyl nucleotides completely abolishes RNAi activity.

In some embodiments, the chemically modified siNA constructs having specificity for target nucleic acid molecules in a cell. Non-limiting examples of such chemical modifications include without limitation phosphorothioate internucleotide linkages, 2'-O-methyl ribonucleotides, 2'-deoxy-2'-fluoro ribonucleotides, "universal base" nucleotides, 5-C-methyl nucleotides, and inverted deoxyabasic residue incorporation. These chemical modifications, when used in various siNA constructs, are shown to preserve RNAi activity in cells while at the same time, dramatically increasing the serum stability of these compounds. Furthermore, contrary to the data published by Parrish et al., supra, applicant demonstrates that multiple (greater than one) phosphorothioate substitutions are well-tolerated and confer substantial increases in serum stability for modified siNA constructs.

In one embodiment, a siNA molecule of the invention comprises modified nucleotides while maintaining the ability to mediate RNAi. The modified nucleotides can be used to improve in vitro or in vivo characteristics such as stability, activity, and/or bioavailability. For example, a siNA molecule of the invention can comprise modified nucleotides as a percentage of the total number of nucleotides present in the siNA molecule. As such, a siNA molecule of the invention can generally comprise modified nucleotides at between 5 and 100% of the nucleotide positions (e.g., 5%, 10%, 15%, 20%, 25%, 30%, 35%, 40%, 45%, 50%, 55%, 60%, 65%, 70%, 75%, 80%, 85%, 90%, 95% or 100% of the nucleotide positions). The actual percentage of modified nucleotides present in a given siNA molecule will depend on the total number of nucleotides present in the siNA. If the siNA molecule is single stranded, the percent modification can be based upon the total number of nucleotides present in the single stranded siNA molecules. Likewise, if the siNA molecule is double stranded, the percent modification can be based upon the total number of nucleotides present in the sense strand, antisense strand, or both the sense and antisense strands. In addition, the actual percentage of modified nucleotides present in a given siNA molecule can also depend on the total number of purine and pyrimidine nucleotides present in the siNA, for example wherein all pyrimidine nucleotides and/or all purine nucleotides present in the siNA molecule are modified.

In a non-limiting example, the introduction of chemically-modified nucleotides into nucleic acid molecules will provide a powerful tool in overcoming potential limitations of in vivo stability and bioavailability inherent to native RNA molecules that are delivered exogenously. For example, the use of chemically-modified nucleic acid molecules can enable a lower dose of a particular nucleic acid molecule for a given therapeutic effect since chemically-modified nucleic acid molecules tend to have a longer half-life in serum. Furthermore, certain chemical modifications can improve the bioavailability of nucleic acid molecules by targeting particular cells or tissues and/or improving cellular uptake of the nucleic acid molecule. Therefore, even if the activity of a chemically-modified nucleic acid molecule is reduced as compared to a native nucleic acid molecule, for example when compared to an all-RNA nucleic acid molecule, the overall activity of the modified nucleic acid molecule can be greater than that of the native molecule due to improved stability and/or delivery of the molecule. Unlike native unmodified siNA, chemically-modified siNA can also minimize the possibility of activating interferon activity in humans.

The antisense region of a siNA molecule of the invention can comprise a phosphorothioate internucleotide linkage at the 3'-end of said antisense region. The antisense region can comprise between about one and about five phosphorothioate internucleotide linkages at the 5'-end of said antisense region. The 3'-terminal nucleotide overhangs of a siNA molecule of the invention can comprise ribonucleotides or deoxyribonucleotides that are chemically-modified at a nucleic acid sugar, base, or backbone. The 3'-terminal nucleotide overhangs can comprise one or more universal base ribonucleotides. The 3'-terminal nucleotide overhangs can comprise one or more acyclic nucleotides.

In certain embodiments, the chemically-modified short interfering nucleic acid (siNA) molecule capable of mediating RNA interference (RNAi) inside a cell or reconstituted in vitro system, includes one or more chemically modified nucleotides (e.g., about 1, 2, 3, 4, 5, 6, 7, 8, 9, 10, or more) comprising a backbone modified internucleotide linkage having Formula I:

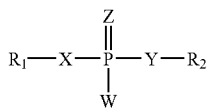

wherein each R1 and R2 is independently any nucleotide, non-nucleotide, or oligonucleotide which can be naturally-occurring or chemically-modified, each X and Y is independently O, S, N, alkyl, or substituted alkyl, each Z and W is independently O, S, N, alkyl, substituted alkyl, O-alkyl, S-alkyl, alkaryl, or aralkyl, and wherein W, X, Y, and Z are optionally not all O.

The chemically-modified internucleotide linkages having Formula I, for example wherein any Z, W, X, and/or Y independently comprises a sulphur atom, can be present in one or both oligonucleotide strands of the siNA duplex, for example in the sense strand, the antisense strand, or both strands. The siNA molecules of the invention can comprise one or more (e.g., about 1, 2, 3, 4, 5, 6, 7, 8, 9, 10, or more) chemically-modified internucleotide linkages having Formula I at the 3'-end, the 5'-end, or both of the 3' and 5'-ends of the sense strand, the antisense strand, or both strands. For example, an exemplary siNA molecule of the invention can comprise between about 1 and about 5 or more (e.g., about 1, 2, 3, 4, 5, or more) chemically-modified internucleotide linkages having Formula I at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine nucleotides with chemically-modified internucleotide linkages having Formula I in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine nucleotides with chemically-modified internucleotide linkages having Formula I in the sense strand, the antisense strand, or both strands. In another embodiment, a siNA molecule of the invention having internucleotide linkage(s) of Formula I also comprises a chemically-modified nucleotide or non-nucleotide having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula II:

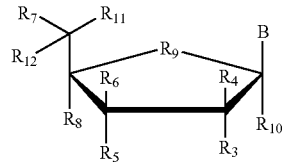

wherein each R3, R4, R5, R6, R7, R8, R10, R1 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or group having Formula I; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA.

The chemically-modified nucleotide or non-nucleotide of Formula II can be present in one or both oligonucleotide strands of the siNA duplex, for example in the sense strand, the antisense strand, or both strands. The siNA molecules of the invention can comprise one or more chemically-modified nucleotide or non-nucleotide of Formula II at the 3'-end, the 5'-end, or both of the 3' and 5'-ends of the sense strand, the antisense strand, or both strands. For example, an exemplary siNA molecule of the invention can comprise between about 1 and about 5 or more (e.g., about 1, 2, 3, 4, 5, or more) chemically-modified nucleotides or non-nucleotides of Formula II at the 5'-end of the sense strand, the antisense strand, or both strands. In anther non-limiting example, an exemplary siNA molecule of the invention can comprise between about 1 and about 5 or more (e.g., about 1, 2, 3, 4, 5, or more) chemically-modified nucleotides or non-nucleotides of Formula II at the 3'-end of the sense strand, the antisense strand, or both strands.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula III:

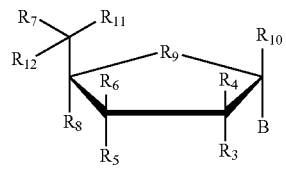

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or group having Formula I; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be employed to be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA.

The chemically-modified nucleotide or non-nucleotide of Formula III can be present in one or both oligonucleotide strands of the siNA duplex, for example in the sense strand, the antisense strand, or both strands. The siNA molecules of the invention can comprise one or more chemically-modified nucleotide or non-nucleotide of Formula III at the 3'-end, the 5'-end, or both of the 3' and 5'-ends of the sense strand, the antisense strand, or both strands. For example, an exemplary siNA molecule of the invention can comprise between about 1 and about 5 or more (e.g., about 1, 2, 3, 4, 5, or more) chemically-modified nucleotide(s) or non-nucleotide(s) of Formula III at the 5'-end of the sense strand, the antisense strand, or both strands. In anther non-limiting example, an exemplary siNA molecule of the invention can comprise between about 1 and about 5 or more (e.g., about 1, 2, 3, 4, 5, or more) chemically-modified nucleotide or non-nucleotide of Formula III at the 3'-end of the sense strand, the antisense strand, or both strands.

In another embodiment, a siNA molecule of the invention comprises a nucleotide having Formula II or III, wherein the nucleotide having Formula II or III is in an inverted configuration. For example, the nucleotide having Formula II or III is connected to the siNA construct in a 3'-3',3'-2',2'-3', or 5'-5' configuration, such as at the 3'-end, the 5'-end, or both of the 3' and 5'-ends of one or both siNA strands.

In one embodiment, the invention features a chemically-modified short interfering nucleic acid (siNA) molecule capable of mediating RNA interference (RNAi) inside a cell or reconstituted in vitro system, wherein the chemical modification comprises a 5'-terminal phosphate group having Formula IV:

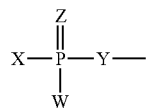

wherein each X and Y is independently O, S, N, alkyl, substituted alkyl, or alkylhalo; wherein each Z and W is independently O, S, N, alkyl, substituted alkyl, O-alkyl, S-alkyl, alkaryl, aralkyl, or alkylhalo; and wherein W, X, Y and Z are not all O.

In one embodiment, the invention features a siNA molecule having a 5'-terminal phosphate group having Formula IV on the target-complementary strand, for example a strand complementary to a target RNA, wherein the siNA molecule comprises an all RNA siNA molecule. In another embodiment, the invention features a siNA molecule having a 5'-terminal phosphate group having Formula IV on the target-complementary strand wherein the siNA molecule also comprises about 1-3 (e.g., about 1, 2, or 3) nucleotide 3'-terminal nucleotide overhangs having between about 1 and about 4 (e.g., about 1, 2, 3, or 4) deoxyribonucleotides on the 3'-end of one or both strands. In another embodiment, a 5'-terminal phosphate group having Formula IV is present on the target-complementary strand of a siNA molecule of the invention, for example a siNA molecule having chemical modifications having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more phosphorothioate internucleotide linkages. For example, in a non-limiting example, the invention features a chemically-modified short interfering nucleic acid (siNA) having about 1, 2, 3, 4, 5, 6, 7, 8 or more phosphorothioate internucleotide linkages in one siNA strand. In yet another embodiment, the invention features a chemically-modified short interfering nucleic acid (siNA) individually having about 1, 2, 3, 4, 5, 6, 7, 8 or more phosphorothioate internucleotide linkages in both siNA strands. The phosphorothioate internucleotide linkages can be present in one or both oligonucleotide strands of the siNA duplex, for example in the sense strand, the antisense strand, or both strands. The siNA molecules of the invention can comprise one or more phosphorothioate internucleotide linkages at the 3'-end, the 5'-end, or both of the 3'- and 5'-ends of the sense strand, the antisense strand, or both strands. For example, an exemplary siNA molecule of the invention can comprise between about 1 and about 5 or more (e.g., about 1, 2, 3, 4, 5, or more) consecutive phosphorothioate internucleotide linkages at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine phosphorothioate internucleotide linkages in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine phosphorothioate internucleotide linkages in the sense strand, the antisense strand, or both strands.

In one embodiment, the invention features a siNA molecule, wherein the sense strand comprises one or more, for example about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3' end, the 5'-end, or both of the 3'- and 5'-ends of the sense strand; and wherein the antisense strand comprises any of between 1 and 10 or more, specifically about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl and/or 2'-deoxy-2'-fluoro nucleotides, with or without one or more, for example about 1, 2, 3, 4, 5, 6, 7, 8, 9, 10, or more, phosphorothioate internucleotide linkages and/or a terminal cap molecule at the 3'-end, the 5'-end, or both of the 3'- and 5'-ends, being present in the same or different strand.

In another embodiment, the invention features a siNA molecule, wherein the sense strand comprises between about 1 and about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand comprises any of between about 1 and about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl and/or 2'-deoxy-2'-fluoro nucleotides, with or without between about 1 and about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

In one embodiment, the invention features a siNA molecule, wherein the antisense strand comprises one or more, for example about 1, 2, 3, 4, 5, 6, 7, 8, 9, 10, or more phosphorothioate internucleotide linkages, and/or between one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises any of between about 1 and about 10, specifically about 1, 2, 3, 4, 5, 6, 7, 8, 9, 10 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl and/or 2'-deoxy-2'-fluoro nucleotides, with or without one or more, for example about 1, 2, 3, 4, 5, 6, 7, 8, 9, 10 or more phosphorothioate internucleotide linkages and/or a terminal cap molecule at the 3'-end, the 5'-end, or both of the 3' and 5'-ends, being present in the same or different strand.

In another embodiment, the invention features a siNA molecule, wherein the antisense strand comprises between about 1 and about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises any of between about 1 and about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl and/or 2'-deoxy-2'-fluoro nucleotides, with or without between about 1 and about 5, for example about 1, 2, 3, 4, 5 or more phosphorothioate internucleotide linkages and/or a terminal cap molecule at the 3'-end, the 5'-end, or both of the 3'- and 5'-ends, being present in the same or different strand.

In one embodiment, the invention features a chemically-modified short interfering nucleic acid (siNA) molecule having between about 1 and about 5, specifically about 1, 2, 3, 4, 5 or more phosphorothioate internucleotide linkages in each strand of the siNA molecule.

In another embodiment, the invention features a siNA molecule comprising 2'-5' internucleotide linkages. The 2'-5' internucleotide linkage(s) can be at the 3'-end, the 5'-end, or both of the 3'- and 5'-ends of one or both siNA sequence strands. In addition, the 2'-5' internucleotide linkage(s) can be present at various other positions within one or both siNA sequence strands, for example, about 1, 2, 3, 4, 5, 6, 7, 8, 9, 10, or more including every internucleotide linkage of a pyrimidine nucleotide in one or both strands of the siNA molecule can comprise a 2'-5' internucleotide linkage, or about 1, 2, 3, 4, 5, 6, 7, 8, 9, 10, or more including every internucleotide linkage of a purine nucleotide in one or both strands of the siNA molecule can comprise a 2'-5' internucleotide linkage.

In another embodiment, a chemically-modified siNA molecule of the invention comprises a duplex having two strands, one or both of which can be chemically-modified, wherein each strand is between about 18 and about 27 (e.g., about 18, 19, 20, 21, 22, 23, 24, 25, 26, or 27) nucleotides in length, wherein the duplex has between about 18 and about 23 (e.g., about 18, 19, 20, 21, 22, or 23) base pairs, and wherein the chemical modification comprises a structure having any of Formulae I-VII. For example, an exemplary chemically-modified siNA molecule of the invention comprises a duplex having two strands, one or both of which can be chemically-modified with a chemical modification having any of Formulae I-VII or any combination thereof, wherein each strand consists of about 21 nucleotides, each having a 2-nucleotide 3'-terminal nucleotide overhang, and wherein the duplex has about 19 base pairs. In another embodiment, a siNA molecule of the invention comprises a single stranded hairpin structure, wherein the siNA is between about 36 and about 70 (e.g., about 36, 40, 45, 50, 55, 60, 65, or 70) nucleotides in length having between about 18 and about 23 (e.g., about 18, 19, 20, 21, 22, or 23) base pairs, and wherein the siNA can include a chemical modification comprising a structure having any of Formulae I-VII or any combination thereof. For example, an exemplary chemically-modified siNA molecule of the invention comprises a linear oligonucleotide having between about 42 and about 50 (e.g., about 42, 43, 44, 45, 46, 47, 48, 49, or 50) nucleotides that is chemically-modified with a chemical modification having any of Formulae I-VII or any combination thereof, wherein the linear oligonucleotide forms a hairpin structure having about 19 base pairs and a 2-nucleotide 3'-terminal nucleotide overhang. In another embodiment, a linear hairpin siNA molecule of the invention contains a stem loop motif, wherein the loop portion of the siNA molecule is biodegradable. For example, a linear hairpin siNA molecule of the invention is designed such that degradation of the loop portion of the siNA molecule in vivo can generate a double-stranded siNA molecule with 3'-terminal overhangs, such as 3'-terminal nucleotide overhangs comprising about 2 nucleotides.

In another embodiment, a siNA molecule of the invention comprises a circular nucleic acid molecule, wherein the siNA is between about 38 and about 70 (e.g., about 38, 40, 45, 50, 55, 60, 65, or 70) nucleotides in length having between about 18 and about 23 (e.g., about 18, 19, 20, 21, 22, or 23) base pairs, and wherein the siNA can include a chemical modification, which comprises a structure having any of Formulae I-VII or any combination thereof. For example, an exemplary chemically-modified siNA molecule of the invention comprises a circular oligonucleotide having between about 42 and about 50 (e.g., about 42, 43, 44, 45, 46, 47, 48, 49, or 50) nucleotides that is chemically-modified with a chemical modification having any of Formulae I-VII or any combination thereof, wherein the circular oligonucleotide forms a dumbbell shaped structure having about 19 base pairs and 2 loops.

In another embodiment, a circular siNA molecule of the invention contains two loop motifs, wherein one or both loop portions of the siNA molecule is biodegradable. For example, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In one embodiment, a siNA molecule of the invention comprises at least one (e.g., about 1, 2, 3, 4, 5, 6, 7, 8, 9, 10, or more) abasic moiety, for example a compound having Formula V:

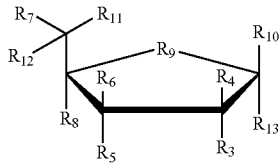

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or group having Formula I; R9 is O, S, CH2, S=O, CHF, or CF2.

In one embodiment, a siNA molecule of the invention comprises at least one (e.g., about 1, 2, 3, 4, 5, 6, 7, 8, 9, 10, or more) inverted abasic moiety, for example a compound having Formula VI:

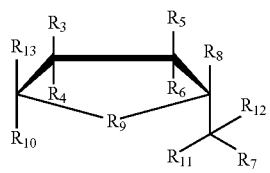

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or group having Formula I; R9 is O, S, CH2, S=O, CHF, or CF2, and either R2, R3, R8 or R13 serve as points of attachment to the siNA molecule of the invention.

In another embodiment, a siNA molecule of the invention comprises at least one (e.g., about 1, 2, 3, 4, 5, 6, 7, 8, 9, 10, or more) substituted polyalkyl moieties, for example a compound having Formula VII:

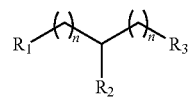

wherein each n is independently an integer from 1 to 12, each R1, R2 and R3 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having Formula I, and R1, R2 or R3 serves as points of attachment to the siNA molecule of the invention.

In another embodiment, the invention features a compound having Formula VII, wherein R1 and R2 are hydroxyl (OH) groups, n=1, and R3 comprises O and is the point of attachment to the 3'-end, the 5'-end, or both of the 3' and 5'-ends of one or both strands of a double-stranded siNA molecule of the invention or to a single-stranded siNA molecule of the invention. This modification is referred to herein as "glyceryl".

In another embodiment, a moiety having any of Formula V, VI or VII of the invention is at the 3'-end, the 5'-end, or both of the 3' and 5'-ends of a siNA molecule of the invention. For example, a moiety having Formula V, VI or VII can be present at the 3'-end, the 5'-end, or both of the 3' and 5'-ends of the antisense strand, the sense strand, or both antisense and sense strands of the siNA molecule. In addition, a moiety having Formula VII can be present at the 3'-end or the 5'-end of a hairpin siNA molecule as described herein.

In another embodiment, a siNA molecule of the invention comprises an abasic residue having Formula V or VI, wherein the abasic residue having Formula VI or VI is connected to the siNA construct in a 3'-3',3'-2',2'-3', or 5'-5' configuration, such as at the 3'-end, the 5'-end, or both of the 3' and 5'-ends of one or both siNA strands.

In one embodiment, a siNA molecule of the invention comprises one or more (e.g., about 1, 2, 3, 4, 5, 6, 7, 8, 9, 10, or more) locked nucleic acid (LNA) nucleotides, for example at the 5'-end, the 3'-end, both of the 5' and 3'-ends, or any combination thereof, of the siNA molecule.

In another embodiment, a siNA molecule of the invention comprises one or more (e.g., about 1, 2, 3, 4, 5, 6, 7, 8, 9, 10, or more) acyclic nucleotides, for example at the 5'-end, the 3'-end, both of the 5' and 3'-ends, or any combination thereof, of the siNA molecule.

In one embodiment, the invention features a chemically-modified short interfering nucleic acid (siNA) molecule of the invention, wherein the chemically-modified siNA comprises a sense region, where any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and where any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention, wherein the chemically-modified siNA comprises a sense region, where any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and where any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention, wherein the chemically-modified siNA comprises an antisense region, where any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

In one embodiment, the invention features a chemically-modified short interfering nucleic acid (siNA) molecule of the invention, wherein the chemically-modified siNA comprises an antisense region, where any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), wherein any nucleotides comprising a 3'-terminal nucleotide overhang that are present in said antisense region are 2'-deoxy nucleotides.

In one embodiment, the invention features a chemically-modified short interfering nucleic acid (siNA) molecule of the invention, wherein the chemically-modified siNA comprises an antisense region, where any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and where any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention capable of mediating RNA interference (RNAi) inside a cell or reconstituted in vitro system, wherein the chemically-modified siNA comprises a sense region, where one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and where one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and inverted deoxy abasic modifications that are optionally present at the 3'-end, the 5'-end, or both of the 3' and 5'-ends of the sense region, the sense region optionally further comprising a 3'-terminal overhang having between about 1 and about 4 (e.g, about 1, 2, 3, or 4) 2'-deoxyribonucleotides; and wherein the chemically-modified short interfering nucleic acid molecule comprises an antisense region, where one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), and a terminal cap modification, such as any modification described herein, that is optionally present at the 3'-end, the 5'-end, or both of the 3' and 5'-ends of the antisense sequence, the antisense region optionally further comprising a 3'-terminal nucleotide overhang having between about 1 and about 4 (e.g, about 1, 2, 3, or 4) 2'-deoxynucleotides, wherein the overhang nucleotides can further comprise one or more (e.g., 1, 2, 3, or 4) phosphorothioate internucleotide linkages.

In one embodiment, the invention features a chemically-modified short interfering nucleic acid (siNA) molecule of the invention capable of mediating RNA interference (RNAi) inside a cell or reconstituted in vitro system, wherein the siNA comprises a sense region, where one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and where one or more purine nucleotides present in the sense region are purine ribonucleotides (e.g., wherein all purine nucleotides are purine ribonucleotides or alternately a plurality of purine nucleotides are purine ribonucleotides), and inverted deoxy abasic modifications that are optionally present at the 3'-end, the 5'-end, or both of the 3' and 5'-ends of the sense region, the sense region optionally further comprising a 3'-terminal overhang having between about 1 and about 4 (e.g, about 1, 2, 3, or 4) 2'-deoxyribonucleotides; and wherein the siNA comprises an antisense region, where one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), and a terminal cap modification, such as any modification described herein, that is optionally present at the 3'-end, the 5'-end, or both of the 3' and 5'-ends of the antisense sequence, the antisense region optionally further comprising a 3'-terminal nucleotide overhang having between about 1 and about 4 (e.g, about 1, 2, 3, or 4) 2'-deoxynucleotides, wherein the overhang nucleotides can further comprise one or more (e.g., 1, 2, 3, or 4) phosphorothioate internucleotide linkages.

In one embodiment, the invention features a chemically-modified short interfering nucleic acid (siNA) molecule of the invention capable of mediating RNA interference (RNAi) inside a cell or reconstituted in vitro system, wherein the chemically-modified siNA comprises a sense region, where one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and for example where one or more purine nucleotides present in the sense region are selected from the group consisting of 2'-deoxy nucleotides, locked nucleic acid (LNA) nucleotides, 2'-methoxyethyl nucleotides, 4'-thionucleotides, and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides), and wherein inverted deoxy abasic modifications are optionally present at the 3'-end, the 5'-end, or both of the 3' and 5'-ends of the sense region, the sense region optionally further comprising a 3'-terminal overhang having between about 1 and about 4 (e.g, about 1, 2, 3, or 4) 2'-deoxyribonucleotides; and wherein the chemically-modified short interfering nucleic acid molecule comprises an antisense region, where one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein one or more purine nucleotides present in the antisense region are selected from the group consisting of 2'-deoxy nucleotides, locked nucleic acid (LNA) nucleotides, 2'-methoxyethyl nucleotides, 4'-thionucleotides, and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides), and a terminal cap modification, that is optionally present at the 3'-end, the 5'-end, or both of the 3' and 5'-ends of the antisense sequence, the antisense region optionally further comprising a 3'-terminal nucleotide overhang having between about 1 and about 4 (e.g, about 1, 2, 3, or 4) 2'-deoxynucleotides, wherein the overhang nucleotides can further comprise one or more (e.g., 1, 2, 3, or 4) phosphorothioate internucleotide linkages.

In another embodiment, any modified nucleotides present in the siNA molecules of the invention, preferably in the antisense strand of the siNA molecules of the invention, comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, Principles of Nucleic Acid Structure, Springer-Verlag ed., 1984). As such, chemically modified nucleotides present in the siNA molecules of the invention, preferably in the antisense strand of the siNA molecules of the invention, are preferably resistant to nuclease degradation while at the same time maintaining the capacity to mediate RNAi. Non-limiting examples of nucleotides having a northern configuration include locked nucleic acid (LNA) nucleotides (e.g., 2'-O,4'-C-methylene-(D-ribofuranosyl) nucleotides); 2'-methoxyethoxy (MOE) nucleotides; 2'-deoxy-2'-fluoro nucleotides, 2'-deoxy-2'-chloro nucleotides, 2'-azido nucleotides, and 2'-O-methyl nucleotides.

In one embodiment, the invention features a chemically-modified short interfering nucleic acid molecule (siNA) capable of mediating RNA interference (RNAi) inside a cell or reconstituted in vitro system, wherein the chemical modification comprises one or more conjugates covalently attached to the chemically-modified siNA molecule. In another embodiment, the conjugate is covalently attached to the chemically-modified siNA molecule via a biodegradable linker. In one embodiment, the conjugate molecule is attached at the 3'-end of either the sense strand, the antisense strand, or both strands of the chemically-modified siNA molecule. In another embodiment, the conjugate molecule is attached at the 5'-end of either the sense strand, the antisense strand, or both strands of the chemically-modified siNA molecule. In yet another embodiment, the conjugate molecule is attached both the 3'-end and 5'-end of either the sense strand, the antisense strand, or both strands of the chemically-modified siNA molecule, or any combination thereof. In one embodiment, a conjugate molecule of the invention comprises a molecule that facilitates delivery of a chemically-modified siNA molecule into a biological system such as a cell. In another embodiment, the conjugate molecule attached to the chemically-modified siNA molecule is a poly ethylene glycol, human serum albumin, or a ligand for a cellular receptor that can mediate cellular uptake. Examples of specific conjugate molecules contemplated by the instant invention that can be attached to chemically-modified siNA molecules are described in Vargeese et al., U.S. Ser. No. 60/311,865, incorporated by reference herein. The type of conjugates used and the extent of conjugation of siNA molecules of the invention can be evaluated for improved pharmacokinetic profiles, bioavailability, and/or stability of siNA constructs while at the same time maintaining the ability of the siNA to mediate RNAi activity. As such, one skilled in the art can screen siNA constructs that are modified with various conjugates to determine whether the siNA conjugate complex possesses improved properties while maintaining the ability to mediate RNAi, for example in animal models as are generally known in the art.

In one embodiment, the invention features a short interfering nucleic acid (siNA) molecule of the invention, wherein the siNA further comprises a nucleotide, non-nucleotide, or mixed nucleotide/non-nucleotide linker that joins the sense region of the siNA to the antisense region of the siNA. In another embodiment, a nucleotide linker of the invention can be a linker of ≧2 nucleotides in length, for example 3, 4, 5, 6, 7, 8, 9, or 10 nucleotides in length. In yet another embodiment, the nucleotide linker can be a nucleic acid aptamer. By "aptamer" or "nucleic acid aptamer" as used herein is meant a nucleic acid molecule that binds specifically to a target molecule wherein the nucleic acid molecule has sequence that is comprises a sequence recognized by the target molecule in its natural setting. Alternately, an aptamer can be a nucleic acid molecule that binds to a target molecule where the target molecule does not naturally bind to a nucleic acid. The target molecule can be any molecule of interest. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art, see for example Gold et al., 1995, Annu. Rev. Biochem., 64, 763; Brody and Gold, 2000, J. Biotechnol., 74, 5; Sun, 2000, Curr. Opin. Mol. Ther., 2, 100; Kusser, 2000, J. Biotechnol., 74, 27; Hermann and Patel, 2000, Science, 287, 820; and Jayasena, 1999, Clinical Chemistry, 45, 1628.

In yet another embodiment, a non-nucleotide linker of the invention comprises abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, Nucleic Acids Res. 1990, 18:6353 and Nucleic Acids Res. 1987, 15:3113; Cload and Schepartz, J. Am. Chem. Soc. 1991, 113:6324; Richardson and Schepartz, J. Am. Chem. Soc. 1991, 113:5109; Ma et al., Nucleic Acids Res. 1993, 21:2585 and Biochemistry 1993, 32:1751; Durand et al., Nucleic Acids Res. 1990, 18:6353; McCurdy et al., Nucleosides & Nucleotides 1991, 10:287; Jschke et al., Tetrahedron Lett. 1993, 34:301; Ono et al., Biochemistry 1991, 30:9914; Arnold et al., International Publication No. WO 89/02439; Usman et al., International Publication No. WO 95/06731; Dudycz et al., International Publication No. WO 95/11910 and Ferentz and Verdine, J. Am. Chem. Soc. 1991, 113:4000, all hereby incorporated by reference herein. A "non-nucleotide" further means any group or compound that can be incorporated into a nucleic acid chain in the place of one or more nucleotide units, including either sugar and/or phosphate substitutions, and allows the remaining bases to exhibit their enzymatic activity. The group or compound can be abasic in that it does not contain a commonly recognized nucleotide base, such as adenosine, guanine, cytosine, uracil or thymine, for example at the C1 position of the sugar.

In one embodiment, the invention features a short interfering nucleic acid (siNA) molecule capable of mediating RNA interference (RNAi) inside a cell or reconstituted in vitro system, wherein one or both strands of the siNA molecule that are assembled from two separate oligonucleotides do not comprise any ribonucleotides. All positions within the siNA can include chemically modified nucleotides and/or non-nucleotides such as nucleotides and or non-nucleotides having Formula I, II, III, IV, V, VI, or VII or any combination thereof to the extent that the ability of the siNA molecule to support RNAi activity in a cell is maintained.

In one embodiment, a siNA molecule of the invention is a single stranded siNA molecule that mediates RNAi activity in a cell or reconstituted in vitro system, wherein the siNA molecule comprises a single stranded oligonucleotide having complementarity to a target nucleic acid sequence. In another embodiment, the single stranded siNA molecule of the invention comprises a 5'-terminal phosphate group. In another embodiment, the single stranded siNA molecule of the invention comprises a 5'-terminal phosphate group and a 3'-terminal phosphate group (e.g., a 2',3'-cyclic phosphate). In another embodiment, the single stranded siNA molecule of the invention comprises between 19 and 29 nucleotides. In yet another embodiment, the single stranded siNA molecule of the invention comprises one or more chemically modified nucleotides or non-nucleotides described herein. For example, all the positions within the siNA molecule can include chemically-modified nucleotides such as nucleotides having any of Formulae I-VII, or any combination thereof to the extent that the ability of the siNA molecule to support RNAi activity in a cell is maintained.

In one embodiment, a siNA molecule of the invention is a single stranded siNA molecule that mediates RNAi activity in a cell or reconstituted in vitro system, wherein the siNA molecule comprises a single stranded oligonucleotide having complementarity to a target nucleic acid sequence, and wherein one or more pyrimidine nucleotides present in the siNA are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), and a terminal cap modification, such as any modification described herein, that is optionally present at the 3'-end, the 5'-end, or both of the 3' and 5'-ends of the antisense sequence, the siNA optionally further comprising between about 1 and about 4 (e.g, about 1, 2, 3, or 4) terminal 2'-deoxynucleotides at the 3'-end of the siNA molecule, wherein the terminal nucleotides can further comprise one or more (e.g., 1, 2, 3, or 4) phosphorothioate internucleotide linkages, and wherein the siNA optionally further comprises a terminal phosphate group, such as a 5'-terminal phosphate group.

In one embodiment, a siNA molecule of the invention is a single stranded siNA molecule that mediates RNAi activity in a cell or reconstituted in vitro system, wherein the siNA molecule comprises a single stranded oligonucleotide having complementarity to a target nucleic acid sequence, and wherein one or more pyrimidine nucleotides present in the siNA are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides), and a terminal cap modification, such as any modification described herein, that is optionally present at the 3'-end, the 5'-end, or both of the 3' and 5'-ends of the antisense sequence, the siNA optionally further comprising between about 1 and about 4 (e.g, about 1, 2, 3, or 4) terminal 2'-deoxynucleotides at the 3'-end of the siNA molecule, wherein the terminal nucleotides can further comprise one or more (e.g., 1, 2, 3, or 4) phosphorothioate internucleotide linkages, and wherein the siNA optionally further comprises a terminal phosphate group, such as a 5'-terminal phosphate group.

In one embodiment, a siNA molecule of the invention is a single stranded siNA molecule that mediates RNAi activity in a cell or reconstituted in vitro system, wherein the siNA molecule comprises a single stranded oligonucleotide having complementarity to a target nucleic acid sequence, and wherein one or more pyrimidine nucleotides present in the siNA are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are locked nucleic acid (LNA) nucleotides (e.g., wherein all purine nucleotides are LNA nucleotides or alternately a plurality of purine nucleotides are LNA nucleotides), and a terminal cap modification, such as any modification described herein, that is optionally present at the 3'-end, the 5'-end, or both of the 3' and 5'-ends of the antisense sequence, the siNA optionally further comprising between about 1 and about 4 (e.g, about 1, 2, 3, or 4) terminal 2'-deoxynucleotides at the 3'-end of the siNA molecule, wherein the terminal nucleotides can further comprise one or more (e.g., 1, 2, 3, or 4) phosphorothioate internucleotide linkages, and wherein the siNA optionally further comprises a terminal phosphate group, such as a 5'-terminal phosphate group.

In one embodiment, a siNA molecule of the invention is a single stranded siNA molecule that mediates RNAi activity in a cell or reconstituted in vitro system, wherein the siNA molecule comprises a single stranded oligonucleotide having complementarity to a target nucleic acid sequence, and wherein one or more pyrimidine nucleotides present in the siNA are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are 2'-methoxyethyl purine nucleotides (e.g., wherein all purine nucleotides are 2'-methoxyethyl purine nucleotides or alternately a plurality of purine nucleotides are 2'-methoxyethyl purine nucleotides), and a terminal cap modification, such as any modification described herein, that is optionally present at the 3'-end, the 5'-end, or both of the 3' and 5'-ends of the antisense sequence, the siNA optionally further comprising between about 1 and about 4 (e.g, about 1, 2, 3, or 4) terminal 2'-deoxynucleotides at the 3'-end of the siNA molecule, wherein the terminal nucleotides can further comprise one or more (e.g., 1, 2, 3, or 4) phosphorothioate internucleotide linkages, and wherein the siNA optionally further comprises a terminal phosphate group, such as a 5'-terminal phosphate group.

In one embodiment, a siNA molecule of the invention is a single stranded siNA molecule that mediates RNAi activity in a cell or reconstituted in vitro system, wherein the siNA molecule comprises a single stranded oligonucleotide having complementarity to a target nucleic acid sequence, and wherein one or more pyrimidine nucleotides present in the siNA are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are purine ribonucleotides (e.g., wherein all purine nucleotides are purine ribonucleotides or alternately a plurality of purine nucleotides are purine ribonucleotides), and a terminal cap modification, such as any modification described herein, that is optionally present at the 3'-end, the 5'-end, or both of the 3' and 5'-ends of the antisense sequence, the siNA optionally further comprising between about 1 and about 4 (e.g, about 1, 2, 3, or 4) terminal 2'-deoxynucleotides at the 3'-end of the siNA molecule, wherein the terminal nucleotides can further comprise one or more (e.g., 1, 2, 3, or 4) phosphorothioate internucleotide linkages, and wherein the siNA optionally further comprises a terminal phosphate group, such as a 5'-terminal phosphate group.

In another embodiment, any modified nucleotides present in the single stranded siNA molecules of the invention comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, Principles of Nucleic Acid Structure, Springer-Verlag ed., 1984). As such, chemically modified nucleotides present in the single stranded siNA molecules of the invention are preferably resistant to nuclease degradation while at the same time maintaining the capacity to mediate RNAi.

E. Preparation of Oligonucleotides

The present oligonucleotides can be prepared by methods available to those skilled in the art. For example, unmodified RNA can be prepared by transcription, e.g., in vitro, using methods and constructs available in the art. The sequence for the particular target, and its complementary sequence can be inserted into a selected vector, and transcribed to produce the desired oligonucleotides by conventional methods.

In many cases, it will be desirable to chemically synthesize the oligonucleotides, e.g., for chemically modified oligonucleotides. Such syntheses are known in the art, and are described, for example, below.

Thus, siNA molecules can be designed to interact with various sites in the RNA message, for example target sequences within the RNA sequences described herein. The sequence of one strand of the siNA molecule(s) is complementary to the target site sequences described above. The siNA molecules can be chemically synthesized using methods described herein. Inactive siNA molecules that are used as control sequences can be synthesized by scrambling the sequence of the siNA molecules such that it is not complementary to the target sequence. Generally, siNA constructs can by synthesized using solid phase oligonucleotide synthesis methods as described herein (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086). Modification of synthesis conditions can be used to optimize coupling efficiency, for example by using differing coupling times, differing reagent/phosphoramidite concentrations, differing contact times, differing solid supports and solid support linker chemistries depending on the particular chemical composition of the siNA to be synthesized. Deprotection and purification of the siNA can be performed as is generally described in Vargeese et al., U.S. Ser. No. 10/194,875, incorporated by reference herein in its entirety. Additionally, deprotection conditions can be modified to provide the best possible yield and purity of siNA constructs. For example, applicant has observed that oligonucleotides comprising 2'-deoxy-2'-fluoro nucleotides can degrade under inappropriate deprotection conditions. Such oligonucleotides are deprotected using aqueous methylamine at about 35° C. for 30 minutes. If the 2'-deoxy-2'-fluoro containing oligonucleotide also comprises ribonucleotides, after deprotection with aqueous methylamine at about 35° C. for 30 minutes, TEA-HF is added and the reaction maintained at about 65° C. for an additional 15 minutes.

Synthesis of Nucleic Acid Molecules

In greater detail, synthesis of nucleic acids greater than 100 nucleotides in length is difficult using automated methods, and the therapeutic cost of such molecules is prohibitive. In this invention, small nucleic acid motifs, "small" refers to nucleic acid motifs no more than 100 nucleotides in length, preferably no more than 80 nucleotides in length, and most preferably no more than 50 nucleotides in length; e.g., individual siNA oligonucleotide sequences or siNA sequences synthesized in tandem) are preferably used for exogenous delivery. The simple structure of these molecules increases the ability of the nucleic acid to invade targeted regions of protein and/or RNA structure. Exemplary molecules of the instant invention are chemically synthesized, and others can similarly be synthesized.

Oligonucleotides (e.g., certain modified oligonucleotides or portions of oligonucleotides lacking ribonucleotides) are synthesized using protocols known in the art, for example as described in Caruthers et al., 1992, Methods in Enzymology 211, 3-19, Thompson et al., International PCT Publication No. WO 99/54459, Wincott et al., 1995, Nucleic Acids Res. 23, 2677-2684, Wincott et al., 1997, Methods Mol. Bio., 74, 59, Brennan et al., 1998, Biotechnol Bioeng., 61, 33-45, and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 2.5 min coupling step for 2'-O-methylated nucleotides and a 45 sec coupling step for 2'-deoxy nucleotides or 2'-deoxy-2'-fluoro nucleotides. Alternatively, syntheses at the 0.2 μmol scale can be performed on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 105-fold excess of S-ethyl tetrazole (60 μL of 0.25 M=15 μmol) can be used in each coupling cycle of 2'-O-methyl residues relative to polymer-bound 5'-hydroxyl. A 22-fold excess (40 μL of 0.11 M=4.4 μmol) of deoxy phosphoramidite and a 70-fold excess of S-ethyl tetrazole (40 μL of 0.25 M=10 μmol) can be used in each coupling cycle of deoxy residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); and oxidation solution is 16.9 mM $I_2$, 49 mM pyridine, 9% water in THF (PERSEPTIVE™). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide, 0.05 M in acetonitrile) is used.

Deprotection of the DNA-based oligonucleotides is performed as follows: the polymer-bound trityl-on oligoribonucleotide is transferred to a 4 mL glass screw top vial and suspended in a solution of 40% aq. methylamine (1 mL) at 65° C. for 10 min. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder.

The method of synthesis used for RNA including certain siNA molecules of the invention follows the procedure as described in Usman et al., 1987, J. Am. Chem. Soc., 109, 7845; Scaringe et al., 1990, Nucleic Acids Res., 18, 5433; and Wincott et al., 1995, Nucleic Acids Res. 23, 2677-2684 Wincott et al., 1997, Methods Mol. Bio., 74, 59, and makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 7.5 min coupling step for alkylsilyl protected nucleotides and a 2.5 min coupling step for 2'-O-methylated nucleotides. Alternatively, syntheses at the 0.2 μmol scale can be done on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 75-fold excess of S-ethyl tetrazole (60 μL of 0.25 M=15 μmol) can be used in each coupling cycle of 2'-O-methyl residues relative to polymer-bound 5'-hydroxyl. A 66-fold excess (120 μL of 0.11 M=13.2 μmol) of alkylsilyl (ribo) protected phosphoramidite and a 150-fold excess of S-ethyl tetrazole (120 μL of 0.25 M=30 μmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); oxidation solution is 16.9 mM $I_2$, 49 mM pyridine, 9% water in THF (PERSEPTIVE™). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide 0.05 M in acetonitrile) is used.

Deprotection of the RNA is performed using either a two-pot or one-pot protocol. For the two-pot protocol, the polymer-bound trityl-on oligoribonucleotide is transferred to a 4 mL glass screw top vial and suspended in a solution of 40% aq. methylamine (1 mL) at 65° C. for 10 min. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder. The base deprotected oligoribonucleotide is resuspended in anhydrous TEA/HF/NMP solution (300 μL of a solution of 1.5 mL N-methylpyrrolidinone, 750 μL TEA and 1 mL TEA•3HF to provide a 1.4 M HF concentration) and heated to 65° C. After 1.5 h, the oligomer is quenched with 1.5 M $NH_4HCO_3$.

Alternatively, for the one-pot protocol, the polymer-bound trityl-on oligoribonucleotide is transferred to a 4 mL glass screw top vial and suspended in a solution of 33% ethanolic methylamine/DMSO: 1/1 (0.8 mL) at 65° C. for 15 min. The vial is brought to r.t. TEA•3HF (0.1 mL) is added and the vial is heated at 65° C. for 15 min. The sample is cooled at −20° C. and then quenched with 1.5 M $NH_4HCO_3$.

For purification of the trityl-on oligomers, the quenched $NH_4HCO_3$ solution is loaded onto a C-18 containing cartridge that had been prewashed with acetonitrile followed by 50 mM TEAA. After washing the loaded cartridge with water, the RNA is detritylated with 0.5% TFA for 13 min. The cartridge is then washed again with water, salt exchanged with 1 M NaCl and washed with water again. The oligonucleotide is then eluted with 30% acetonitrile.

The average stepwise coupling yields are typically >98% (Wincott et al., 1995 Nucleic Acids Res. 23, 2677-2684). Those of ordinary skill in the art will recognize that the scale of synthesis can be adapted to be larger or smaller than the example described above including but not limited to 96-well format.

Alternatively, the nucleic acid molecules of the present invention can be synthesized separately and joined together post-synthetically, for example, by ligation (Moore et al., 1992, Science 256, 9923; Draper et al., International PCT publication No. WO 93/23569; Shabarova et al., 1991, Nucleic Acids Research 19, 4247; Bellon et al., 1997, Nucleosides & Nucleotides, 16, 951; Bellon et al., 1997, Bioconjugate Chem. 8, 204), or by hybridization following synthesis and/or deprotection.

The siNA molecules of the invention can also be synthesized via a tandem synthesis methodology as described below, where both siNA strands are synthesized as a single contiguous oligonucleotide fragment or strand separated by a cleavable linker which is subsequently cleaved to provide separate siNA fragments or strands that hybridize and permit purification of the siNA duplex. The linker can be a oligonucleotide linker or a non-nucleotide linker. The tandem synthesis of siNA as described herein can be readily adapted to both multiwell/multiplate synthesis platforms such as 96 well or similarly larger multi-well platforms. The tandem synthesis of siNA as described herein can also be readily adapted to large scale synthesis platforms employing batch reactors, synthesis columns and the like.

A siNA molecule can also be assembled from two distinct nucleic acid strands or fragments wherein one fragment includes the sense region and the second fragment includes the antisense region of the RNA molecule.

The nucleic acid molecules of the present invention can be modified extensively to enhance stability by modification with nuclease resistant groups, for example, 2'-amino, 2'-C-allyl, 2'-fluoro, 2'-O-methyl, 2'-H (for a review see Usman and Cedergren, 1992, TIBS 17, 34; Usman et al., 1994, Nucleic Acids Symp. Ser. 31, 163). siNA constructs can be purified by gel electrophoresis using general methods or can be purified by high pressure liquid chromatography (HPLC; see Wincott et al., supra, the totality of which is hereby incorporated herein by reference) and re-suspended in water.

In another aspect of the invention, siNA molecules of the invention are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules.

Tandem Synthesis of siNA Constructs

Exemplary siNA molecules are synthesized in tandem using a cleavable linker, for example a succinyl-based linker. Tandem synthesis as described herein is followed by a one-step purification process that provides RNAi molecules in high yield. This approach is highly amenable to siNA synthesis in support of high throughput RNAi screening, and can be readily adapted to multi-column or multi-well synthesis platforms.

After completing a tandem synthesis of an siNA oligo and its complement in which the 5'-terminal dimethoxytrityl (5'-O-DMT) group remains intact (trityl on synthesis), the oligonucleotides are deprotected as described above. Following deprotection, the siNA sequence strands are allowed to spontaneously hybridize. This hybridization yields a duplex in which one strand has retained the 5'-O-DMT group while the complementary strand comprises a terminal 5'-hydroxyl. The newly formed duplex behaves as a single molecule during routine solid-phase extraction purification (Trityl-On purification) even though only one molecule has a dimethoxytrityl group. Because the strands form a stable duplex, this dimethoxytrityl group (or an equivalent group, such as other trityl groups or other hydrophobic moieties) is all that is required to purify the pair of oligos, for example by using a C18 cartridge.

Standard phosphoramidite synthesis chemistry is used up to point of introducing a tandem linker, such as an inverted deoxy abasic succinate or glyceryl succinate linker or an equivalent cleavable linker. A non-limiting example of linker coupling conditions that can be used includes a hindered base such as diisopropylethylamine (DIPA) and/or DMAP in the presence of an activator reagent such as Bromotripyrrolidinophosphoniumhexafluororophosphate (PyBrOP). After the linker is coupled, standard synthesis chemistry is utilized to complete synthesis of the second sequence leaving the terminal the 5'-O-DMT intact. Following synthesis, the resulting oligonucleotide is deprotected according to the procedures described herein and quenched with a suitable buffer, for example with 50 mM NaOAc or 1.5M $NH_4H_2CO_3$.

Purification of the siNA duplex can be readily accomplished using solid phase extraction, for example using a Waters C18 SepPak 1 g cartridge conditioned with 1 column volume (CV) of acetonitrile, 2 CV H2O, and 2 CV 50 mM NaOAc: The sample is loaded and then washed with 1 CV H2O or 50 mM NaOAc. Failure sequences are eluted with 1 CV 14% ACN (Aqueous with 50 mM NaOAc and 50 mM NaCl). The column is then washed, for example with 1 CV H2O followed by on-column detritylation, for example by passing 1 CV of 1% aqueous trifluoroacetic acid (TFA) over the column, then adding a second CV of 1% aqueous TFA to the column and allowing to stand for approx. 10 minutes. The remaining TFA solution is removed and the column washed with H2O followed by 1 CV 1 M NaCl and additional H2O. The siNA duplex product is then eluted, for example using 1 CV 20% aqueous CAN.

Optimizing Activity of the Nucleic Acid Molecules.

Chemically synthesizing nucleic acid molecules with modifications (base, sugar and/or phosphate) can prevent their degradation by serum ribonucleases, which can increase their potency (see e.g., Eckstein et al., International Publication No. WO 92/07065; Perrault et al., 1990 Nature 344, 565; Pieken et al., 1991, Science 253, 314; Usman and Cedergren, 1992, Trends in Biochem. Sci. 17, 334; Usman et al., International Publication No. WO 93/15187; and Rossi et al., International Publication No. WO 91/03162; Sproat, U.S. Pat. No. 5,334,711; Gold et al., U.S. Pat. No. 6,300,074; and Burgin et al., supra; all of which are incorporated by reference herein). All of the above references describe various chemical modifications that can be made to the base, phosphate and/or sugar moieties of the nucleic acid molecules described herein. Modifications that enhance their efficacy in cells, and removal of bases from nucleic acid molecules to shorten oligonucleotide synthesis times and reduce chemical requirements are desired.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren, 1992, TIBS. 17, 34; Usman et al., 1994, Nucleic Acids Symp. Ser. 31, 163; Burgin et al., 1996, Biochemistry, 35, 14090). Sugar modification of nucleic acid molecules have been extensively described in the art (see Eckstein et al., International Publication PCT No. WO 92/07065; Perrault et al. Nature, 1990, 344, 565-568; Pieken et al. Science, 1991, 253, 314-317; Usman and Cedergren, Trends in Biochem. Sci., 1992, 17, 334-339; Usman et al. International Publication PCT No. WO 93/15187; Sproat, U.S. Pat. No. 5,334,711 and Beigelman et al., 1995, J. Biol. Chem., 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, Tetrahedron Lett., 39, 1131; Earnshaw and Gait, 1998, Biopolymers (Nucleic Acid Sciences), 48, 39-55; Verma and Eckstein, 1998, Annu. Rev. Biochem., 67, 99-134; and Burlina et al., 1997, Bioorg. Med. Chem., 5, 1999-2010; all of the references are hereby incorporated in their totality by reference herein). Such publications describe general methods and strategies to determine the location of incorporation of sugar, base and/or phosphate modifications and the like into nucleic acid molecules without modulating catalysis, and are incorporated by reference herein. In view of such teachings, similar modifications can be used as described herein to modify the siNA nucleic acid molecules of the instant invention so long as the ability of siNA to promote RNAi is cells is not significantly inhibited.

While chemical modification of oligonucleotide internucleotide linkages with phosphorothioate, phosphorodithioate, and/or 5'-methylphosphonate linkages improves stability, excessive modifications can cause some toxicity or decreased activity. Therefore, when designing nucleic acid molecules, the amount of these internucleotide linkages should be minimized. The reduction in the concentration of these linkages should lower toxicity, resulting in increased efficacy and higher specificity of these molecules.

Short interfering nucleic acid (siNA) molecules having chemical modifications that maintain or enhance activity are provided. Such a nucleic acid is also generally more resistant to nucleases than an unmodified nucleic acid. Accordingly, the in vitro and/or in vivo activity should not be significantly lowered. In cases in which modulation is the goal, therapeutic nucleic acid molecules delivered exogenously should optimally be stable within cells until translation of the target RNA has been modulated long enough to reduce the levels of the undesirable protein. This period of time varies between hours to days depending upon the disease state. Improvements in the chemical synthesis of RNA and DNA (Wincott et al., 1995, Nucleic Acids Res. 23, 2677; Caruthers et al., 1992, Methods in Enzymology 211, 3-19 (incorporated by reference herein)) have expanded the ability to modify nucleic acid molecules by introducing nucleotide modifications to enhance their nuclease stability, as described above.

In one embodiment, nucleic acid molecules of the invention include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, J. Am. Chem. Soc., 120, 8531-8532. A single G-clamp analog substitution within an oligonucleotide can result in substantially enhanced helical thermal stability and mismatch discrimination when hybridized to complementary oligonucleotides. The inclusion of such nucleotides in nucleic acid molecules of the invention results in both enhanced affinity and specificity to nucleic acid targets, complementary sequences, or template strands. In another embodiment, nucleic acid molecules of the invention include one or more (e.g., about 1, 2, 3, 4, 5, 6, 7, 8, 9, 10, or more) LNA "locked nucleic acid" nucleotides such as a 2',4'-C mythylene bicyclo nucleotide (see for example Wengel et al., International PCT Publication No. WO 00/66604 and WO 99/14226).

In another embodiment, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. The present invention encompasses the design and synthesis of novel conjugates and complexes for the delivery of molecules, including, but not limited to, small molecules, lipids, phospholipids, nucleosides, nucleotides, nucleic acids, antibodies, toxins, negatively charged polymers and other polymers, for example proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules of the invention into a number of cell types originating from different tissues, in the presence or absence of serum (see Sullenger and Cech, U.S. Pat. No. 5,854,038). Conjugates of the molecules described herein can be attached to biologically active molecules via linkers that are biodegradable, such as biodegradable nucleic acid linker molecules.

The term "biodegradable linker" as used herein, refers to a nucleic acid or non-nucleic acid linker molecule that is designed as a biodegradable linker to connect one molecule to another molecule, for example, a biologically active molecule to a siNA molecule of the invention or the sense and antisense strands of a siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically-modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The term "biodegradable" as used herein, refers to degradation in a biological system, for example enzymatic degradation or chemical degradation.

The term "biologically active molecule" as used herein, refers to compounds or molecules that are capable of eliciting or modifying a biological response in a system. Non-limiting examples of biologically active siNA molecules either alone or in combination with other molecules contemplated by the instant invention include therapeutically active molecules such as antibodies, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, 2,5-A chimeras, siNA, dsRNA, allozymes, aptamers, decoys and analogs thereof. Biologically active molecules of the invention also include molecules capable of modulating the pharmacokinetics and/or pharmacodynamics of other biologically active molecules, for example, lipids and polymers such as polyamines, polyamides, polyethylene glycol and other polyethers.

The term "phospholipid" as used herein, refers to a hydrophobic molecule comprising at least one phosphorus group. For example, a phospholipid can comprise a phosphorus-containing group and saturated or unsaturated alkyl group, optionally substituted with OH, COOH, oxo, amine, or substituted or unsubstituted aryl groups.

Therapeutic nucleic acid molecules (e.g., siNA molecules) delivered exogenously optimally are stable within cells until reverse transcription of the RNA has been modulated long enough to reduce the levels of the RNA transcript. The nucleic acid molecules are resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

In yet another embodiment, siNA molecules having chemical modifications that maintain or enhance enzymatic activity of proteins involved in RNAi are provided. Such nucleic acids are also generally more resistant to nucleases than unmodified nucleic acids. Thus, in vitro and/or in vivo the activity should not be significantly lowered.

Use of the nucleic acid-based molecules of the invention will lead to better treatment of the disease progression by affording the possibility of combination therapies (e.g., multiple siNA molecules targeted to different genes; nucleic acid molecules coupled with known small molecule modulators; or intermittent treatment with combinations of molecules, including different motifs and/or other chemical or biological molecules). The treatment of subjects with siNA molecules can also include combinations of different types of nucleic acid molecules, such as enzymatic nucleic acid molecules (ribozymes), allozymes, antisense, 2,5-A oligoadenylate, decoys, and aptamers.

In another aspect a siNA molecule of the invention comprises one or more 5' and/or a 3'-cap structure, for example on only the sense siNA strand, the antisense siNA strand, or both siNA strands.

By "cap structure" is meant chemical modifications, which have been incorporated at either terminus of the oligonucleotide (see, for example, Adamic et al., U.S. Pat. No. 5,998,203, incorporated by reference herein). These terminal modifications protect the nucleic acid molecule from exonuclease degradation, and may help in delivery and/or localization within a cell. The cap may be present at the 5'-terminus (5'-cap) or at the 3'-terminal (3'-cap) or may be present on both termini. In non-limiting examples: the 5'-cap is selected from the group comprising glyceryl, inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety.

In yet another embodiment, the 3'-cap is selected from a group comprising glyceryl, inverted deoxy abasic residue (moiety), 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Iyer, 1993, Tetrahedron 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine and therefore lacks a base at the 1'-position.

An "alkyl" group refers to a saturated aliphatic hydrocarbon, including straight-chain, branched-chain, and cyclic alkyl groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted the substituted group(s) is preferably, hydroxyl, cyano, alkoxy, =O, =S, $NO_2$ or $N(CH_3)_2$, amino, or SH. The term also includes alkenyl groups that are unsaturated hydrocarbon groups containing at least one carbon-carbon double bond, including straight-chain, branched-chain, and cyclic groups. Preferably, the alkenyl group has 1 to 12 carbons. More preferably, it is a lower alkenyl of from 1 to 7 carbons, more preferably 1 to 4 carbons. The alkenyl group may be substituted or unsubstituted. When substituted the substituted group(s) is preferably, hydroxyl, cyano, alkoxy, =O, =S, $NO_2$, halogen, $N(CH_3)_2$, amino, or SH. The term "alkyl" also includes alkynyl groups that have an unsaturated hydrocarbon group containing at least one carbon-carbon triple bond, including straight-chain, branched-chain, and cyclic groups. Preferably, the alkynyl group has 1 to 12 carbons. More preferably, it is a lower alkynyl of from 1 to 7 carbons, more preferably 1 to 4 carbons. The alkynyl group may be substituted or unsubstituted. When substituted the substituted group(s) is preferably, hydroxyl, cyano, alkoxy, =O, =S, $NO_2$ or $N(CH_3)_2$, amino or SH.

Such alkyl groups can also include aryl, alkylaryl, carbocyclic aryl, heterocyclic aryl, amide and ester groups. An "aryl" group refers to an aromatic group that has at least one ring having a conjugated pi electron system and includes carbocyclic aryl, heterocyclic aryl and biaryl groups, all of which may be optionally substituted. The preferred substituent(s) of aryl groups are halogen, trihalomethyl, hydroxyl, SH, OH, cyano, alkoxy, alkyl, alkenyl, alkynyl, and amino groups. An "alkylaryl" group refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and include furanyl, thienyl, pyridyl, pyrrolyl, N-lower alkyl pyrrolo, pyrimidyl, pyrazinyl, imidazolyl and the like, all optionally substituted. An "amide" refers to an —C(O)—NH—R, where R is either alkyl, aryl, alkylaryl or hydrogen. An "ester" refers to an —C(O)—OR', where R is either alkyl, aryl, alkylaryl or hydrogen.

By "nucleotide" as used herein is as recognized in the art to include natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, for example, Usman and McSwiggen, supra; Eckstein et al., International PCT Publication No. WO 92/07065; Usman et al., International PCT Publication No. WO 93/15187; Uhlman & Peyman, supra, all are hereby incorporated by reference herein). There are several examples of modified nucleic acid bases known in the art as summarized by Limbach et al., 1994, Nucleic Acids Res. 22, 2183. Some of the non-limiting examples of base modifications that can be introduced into nucleic acid molecules include, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin et al., 1996, Biochemistry, 35, 14090; Uhlman & Peyman, supra). By "modified bases" in this aspect is meant nucleotide bases other than adenine, guanine, cytosine and uracil at 1' position or their equivalents.

In one embodiment, the invention features modified siNA molecules, with phosphate backbone modifications comprising one or more phosphorothioate, phosphorodithioate, methylphosphonate, phosphotriester, morpholino, amidate carbamate, carboxymethyl, acetamidate, polyamide, sulfonate, sulfonamide, sulfamate, formacetal, thioformacetal, and/or alkylsilyl, substitutions. For a review of oligonucleotide backbone modifications, see Hunziker and Leumann, 1995, Nucleic Acid Analogues: Synthesis and Properties, in Modern Synthetic Methods, VCH, 331-417, and Mesmaeker et al., 1994, Novel Backbone Replacements for Oligonucleotides, in Carbohydrate Modifications in Antisense Research, ACS, 24-39.

By "abasic" is meant sugar moieties lacking a base or having other chemical groups in place of a base at the 1' position, see for example Adamic et al., U.S. Pat. No. 5,998, 203.

By "unmodified nucleoside" is meant one of the bases adenine, cytosine, guanine, thymine, or uracil joined to the 1' carbon of β-D-ribo-furanose.

By "modified nucleoside" is meant any nucleotide base which contains a modification in the chemical structure of an unmodified nucleotide base, sugar and/or phosphate. Non-limiting examples of modified nucleotides are shown by Formulae I-VII and/or other modifications described herein.

In connection with 2'-modified nucleotides as described for the present invention, by "amino" is meant 2'—$NH_2$ or 2'-O—$NH_2$, which may be modified or unmodified. Such modified groups are described, for example, in Eckstein et al., U.S. Pat. No. 5,672,695 and Matulic-Adamic et al., U.S. Pat. No. 6,248,878, which are both incorporated by reference in their entireties.

Various modifications to nucleic acid siNA structure can be made to enhance the utility of these molecules. Such modifications will enhance shelf-life, half-life in vitro, stability, and ease of introduction of such oligonucleotides to the target site, e.g., to enhance penetration of cellular membranes, and confer the ability to recognize and bind to targeted cells.

F. Compositions for Administration

Suitable pharmaceutical compositions containing the present RNAi inducing oligonucleotides can be prepared in many different forms. In most cases, it is desirable to apply the active oligonucleotide topically to one or more hair producing skin areas on a subject. For these applications, a composition that flows, or is spreadable or sprayable is advantageous. Examples of such compositions include, for example, solutions, suspensions, emulsions, lotions, creams, gels, ointments, liposome preparations, and the like. Preparation of such pharmaceutical compositions is well-known in the art, and can be utilized for the present invention.

Thus, the oligonucleotide formulations useful in the present invention will generally include the oligonucleotide(s) and a pharmaceutically acceptable carrier, e.g., any liquid or nonliquid carrier, gel, cream, ointment, lotion, paste, emulsifier, solvent, liquid diluent, powder, or the like, which is stable with respect to all components of the topical pharmaceutical formulation and which is suitable for topical administration of oligonucleotides according to the method of the invention. Such carriers are well known in the art.

A topical carrier, as noted above, is one which is generally suited to topical drug administration and includes any such materials known in the art. The topical carrier is selected so as to provide the composition in the desired form, e.g., as a liquid, lotion, cream, paste, gel, or ointment, and may be comprised of a material of either naturally occurring or synthetic origin. It is essential, clearly, that the selected carrier not adversely affect the oligonucleotide or other components of the topical formulation. Examples of suitable topical carriers for use herein include water, alcohols and other nontoxic organic solvents, glycerin, mineral oil, silicone, petroleum jelly, lanolin, fatty acids, vegetable oils, waxes, and the like. Particularly preferred formulations herein are colorless, odorless ointments, lotions, creams and gels.

Ointments, which are semisolid preparations, are typically based on petrolatum or other petroleum derivatives. As will be appreciated by the ordinarily skilled artisan, the specific ointment base to be used is one that provides for optimum oligonucleotide delivery, and, preferably, provides for other desired characteristics as well, e.g., emolliency or the like. As with other carriers or vehicles, an ointment base should be inert, stable, nonirritating and nonsensitizing. As explained in Remington: The Science and Practice of Pharmacy, 19th Ed. (Easton, Pa.: Mack Publishing Co., 1995), at pages 1399-1404, ointment bases may be grouped in four classes: oleaginous bases; emulsifiable bases; emulsion bases; and water-soluble bases. Oleaginous ointment bases include, for example, vegetable oils, fats obtained from animals, and semisolid hydrocarbons obtained from petroleum. Emulsifiable ointment bases, also known as absorbent ointment bases, contain little or no water and include, for example, hydroxystearin sulfate, anhydrous lanolin and hydrophilic petrolatum. Emulsion ointment bases are either water-in-oil (W/O) emulsions or oil-in-water (O/W) emulsions, and include, for example, cetyl alcohol, glyceryl monostearate, lanolin and stearic acid. Preferred water-soluble ointment bases are prepared from polyethylene glycols of varying molecular weight; again, reference may be had to Remington: The Science and Practice of Pharmacy for further information.

Lotions, which are preparations that are to be applied to the skin surface without friction, are typically liquid or semiliquid preparations in which solid particles, including the oligonucleotide, are present in a water or alcohol base. Lotions are usually suspensions of solids, and preferably, for the present purpose, comprise a liquid oily emulsion of the oil-in-water type. Lotions are preferred formulations for oligonucleotide delivery to large body areas, because of the ease of applying a more fluid composition. It is generally necessary that the insoluble matter in a lotion be finely divided. Lotions will typically contain suspending agents to produce better dispersions as well as compounds useful for localizing and holding the active agent in contact with the skin, e.g., methylcellulose, sodium carboxymethyl-cellulose, or the like.

Creams containing a oligonucleotide for delivery according to the method of the invention are viscous liquid or semisolid emulsions, either oil-in-water or water-in-oil. Cream bases are water-washable, and contain an oil phase, an emulsifier and an aqueous phase. The oil phase, also sometimes called the "internal" phase, is generally comprised of petrolatum and a fatty alcohol such as cetyl or stearyl alcohol; the aqueous phase usually, although not necessarily, exceeds the oil phase in volume, and generally contains a humectant. The emulsifier in a cream formulation, as explained in Remington, supra, is generally a nonionic, anionic, cationic or amphoteric surfactant.

Gel formulations can also be used in connection with the present invention. As will be appreciated by those working in the field of topical drug formulation, gels are semisolid, suspension-type systems. Single-phase gels contain organic macromolecules distributed substantially uniformly throughout the carrier liquid, which is typically aqueous, but also, preferably, contain an alcohol and, optionally, an oil.

The oligonucleotide formulations useful in the invention also encompass sprays, that generally provide the oligonucleotide in an aqueous solution which can be misted onto the skin for delivery. Such sprays include those formulated to provide for concentration of the oligonucleotide solution at the site of administration following delivery, e.g., the spray solution can be primarily composed of alcohol or other like volatile liquid in which the oligonucleotide can be dissolved. Upon delivery to the skin, the alcohol carrier evaporates, leaving concentrated oligonucleotide at the site of administration.

The oligonucleotide formulations useful in the invention can also contain other optional such as opacifiers, anti-oxidants, gelling agents, thickening agents, stabilizers, and the like. Other agents may also be added, such as antimicrobial agents, antifungal agents, antibiotics and anti-inflammatory agents such as steroids.

The oligonucleotide formulations can include other components that, while not necessary for delivery of oligonucleotides to the skin, may enhance such delivery. For example, although it is not necessary to the practice of the invention, the oligonucleotide formulations may also contain a skin permeation enhancer. Suitable enhancers are well know in the art and include, for example, dimethylsulfoxide (DMSO), dimethyl formamide (DMF), N,N-dimethylacetamide (DMA), decylmethylsulfoxide ($C_{10}$ MSO), $C_2$-$C_6$ alkanediols, and the 1-substituted azacycloheptan-2-ones, particularly 1-n-dodecylcyclazacycloheptan-2-one (available under the trademark Azone® from Whitby Research Incorporated, Richmond, Va.), alcohols, and the like. Preferably, the oligonucleotides delivered are substantially free of such permeation enhancers.

The additional components should not substantially interfere with the integrity or biological activity of the oligonucleotide or the formulation in which it is provided, i.e., the additional components do not adversely affect the uptake of the oligonucleotide by skin cells or chemically modify the oligonucleotide in an undesirable manner.

It will be recognized by those skilled in the art that the optimal quantity and spacing of individual dosages of oligonucleotides will be determined by the precise form and components of the oligonucleotide formulation to be delivered, the site of administration, the use to which the delivery device is applied (e.g., immunization, treatment of a condition, production of transgenic animals, etc.), and the particular subject to which the oligonucleotide formulation is to be delivered, and that such optimums can be determined by conventional techniques. It will also be appreciated by one skilled in the art that the optimal dosing regimen, i.e., the number of doses of oligonucleotides, can be ascertained using conventional methods, e.g., course of treatment determination tests. Generally, a dosing regimen will involve administration of the selected oligonucleotide formulation at least once daily, and may be one to four times daily or more.

The practice of the present invention will employ, unless otherwise indicated, conventional techniques of drug formulation, particularly topical drug formulation, which are within the skill of the art. Such techniques are fully explained in the literature. See Remington: The Science and Practice of Pharmacy, cited supra, as well as Goodman & Gilman's The Pharmacological Basis of Therapeutics, 9th Ed. (New York: McGraw-Hill, 1996).

Dosage Forms of the Oligonucleotide Formulations

The oligonucleotides can be prepared in unit dosage form (e.g., in ampules), or in multidose form. The oligonucleotides may be present in such forms as suspensions, solutions, gels, or creams, preferably in an aqueous vehicle (e.g., in a buffered solution). Alternatively, the oligonucleotide salt may be in lyophilized form for reconstitution, at the time of delivery, with a suitable vehicle, such as sterile pyrogen-free water or phosphate-buffered saline (PBS). Both liquid as well as lyophilized forms that are to be reconstituted preferably comprise agents, preferably buffers, in amounts necessary to suitably adjust the pH of the solution. Nonionic materials, such as sugars, are preferred for adjusting tonicity, and sucrose is particularly preferred. Any of these forms may further comprise suitable formulatory agents, such as starch or sugar, glycerol or saline. The compositions per unit dosage, whether liquid, gel, cream, or solid, may contain from 0.1% to 99% of oligonucleotide material.

Delivery Devices

The oligonucleotide formulation can administered using and be provided within, a delivery device (e.g., a patch, bandage, etc.) that provides for both maintenance of contact between the skin of the subject and the oligonucleotide formulation and substantially uninhibited movement of the oligonucleotide into the skin. The delivery device generally does not in and of itself facilitate movement of the oligonucleotide contained therein into the skin, but rather primarily acts to ensure that the oligonucleotide formulation is in contact with the skin for a time sufficient to allow genetic alteration of skin cells. The delivery device comprises a delivery means, or "reservoir," which is saturated with a formulation that comprises an amount of oligonucleotide sufficient to genetic alteration of skin cells to which it is to be delivered and sufficient to elicit the desired biological effect. For example, where the delivery device is to be used to deliver a oligonucleotide for genetic immunization of a human, the delivery means of the device preferably contains an amount of oligonucleotide ranging from about 10 .mu.g to about 1,000 .mu.g, preferably from about 100 .mu.g to about 500 .mu.g.

Suitable delivery means of the delivery devices of the invention include, but are not limited to, sponges, hydrogels, and absorptive materials (e.g., gauze) that allow for retention of the oligonucleotide formulation at the site of oligonucleotide administration without substantially interfering with the delivery of oligonucleotide to the skin. It is important that, upon contact of the delivery means with the skin, the oligonucleotides contained in the delivery means diffuse or otherwise pass from the delivery means into the skin at a rate and in an amount suitable to accomplish the desired effect.

In general, the delivery means has at least two surfaces: a first surface that serves as a skin-contacting surface; and a second surface opposite the skin-contacting surface. Preferably, the second surface is in contact with a liquid-impermeable coating that substantially prevents movement of the oligonucleotide out of the delivery means through the second surface (e.g., in a direction away from the first skin-contacting surface). Preferably, the liquid-impermeable coating also decreases the rate of dehydration of the oligonucleotide formulation contained in the delivery means. In one embodiment, the first skin-contacting surface of the delivery means is associated with a liquid-impermeable, removable layer (e.g., release liner), which layer is removed just prior to placement of the first surface on the skin of a subject for administration of the oligonucleotide.

The delivery device preferably comprises an adhesive means, which can be a polymeric matrix of a pharmaceutically acceptable contact adhesive material, which serves to affix the system to the skin during drug delivery. The adhesive means facilitates retention of the delivery means on the skin at the desired site of administration. Preferably, the adhesive means comprises an adhesive substance that allows for retention of the delivery means at the desired site for a selected amount of time, but additionally allows for easy removal of the delivery means without substantially adversely affecting the skin with which the adhesive substance was in contact.

The adhesive substance used must be biocompatible with the skin of the subject, and should not substantially interfere with the delivery of oligonucleotide to the subject. Examples of suitable skin contact adhesive materials include, but are not limited to, polyethylenes, polysiloxanes, polyisobutylenes, polyacrylates, polyurethanes, and the like. The particular polymeric adhesive selected will depend on the particular oligonucleotide formulation, vehicle, etc., i.e., the adhesive must be compatible with all components of the oligonucleotide formulation.

In one embodiment, the delivery means and skin contact adhesive are present as separate and distinct layers of the delivery device, with the adhesive underlying the delivery means which, in this case, may be either a polymeric matrix as described above, or it may be a liquid or hydrogel reservoir, or may take some other form. In another embodiment, the delivery means is an adhesive bandage. Exemplary delivery devices suitable for use in the invention include, but are not limited to, those devices described in U.S. Pat. No. 5,160,328; U.S. Pat. No. 5,254,346; U.S. Pat. No. 5,714,162; U.S. Pat. No. 5,667,798; U.S. Pat. No. 5,230,896; and U.S. Pat. No. 5,260,066. Methods for preparation of suitable delivery means and other elements associated with the delivery means, such as an adhesive means are well known in the art.

In another embodiment, the oligonucleotide formulation of the invention is provided as a patch, wherein the drug composition is contained within, for example, a laminated structure that serves as a drug delivery device to be affixed to the skin. In such a structure, the oligonucleotide composition is contained within a delivery means, or "reservoir," which lies beneath an upper backing layer. The laminated structure may contain a single reservoir, or it may contain multiple reservoirs.

The backing layer in the laminates of the patch, which serves as the upper surface of the delivery device, functions as the primary structural element of the laminated structure and provides the device with much of its flexibility. The material selected for the backing material should be selected so that it is substantially impermeable to oligonucleotide and, preferably, to other components of the oligonucleotide formulation, thus preventing loss of any components through the upper surface of the device, and preferably substantially impeding dehydration of the composition in the reservoir. The backing layer may be either occlusive or nonocclusive, depending on whether it is desired that the skin become hydrated during drug delivery. The backing is preferably made of a sheet or film of a preferably flexible elastomeric material. Examples of polymers that are suitable for the backing layer include polyethylene, polypropylene, polyesters, and the like.

During storage and prior to use, the laminated structure includes a release liner. Immediately prior to use, this layer is removed from the device to expose the skin-contacting surface of the device, which as noted above may be either the reservoir itself or a separate contact adhesive layer, so that the system may be affixed to the skin. The release liner is preferably made of a material that is substantially impermeable to the oligonucleotide and other components in the oligonucleotide formulation.

Delivery devices suitable for use in the present invention may be fabricated using conventional techniques, known in the art, for example by casting a fluid admixture of adhesive, oligonucleotide, and carrier/vehicle onto the backing layer, followed by lamination of the release liner. Similarly, the adhesive mixture may be cast onto the release liner, followed by lamination of the backing layer. Alternatively, the oligonucleotide reservoir may be prepared in the absence of oligonucleotide formulation or excipient, and then loaded by "soaking" in a drug/vehicle mixture.

As with the topical formulations of the invention, the oligonucleotide formulation contained within the delivery means of the delivery devices may contain a number of components. Furthermore, such delivery devices can be used in connection with administration of any of the oligonucleotide formulations described herein, e.g., naked oligonucleotide formulations, or lipid- or liposome-comprising oligonucleotide formulations. Regardless of the specific basic components of the oligonucleotide formulation, the oligonucleotide formulation will generally dissolved, dispersed or suspended in a suitable pharmaceutically acceptable vehicle, typically an aqueous solution or gel. Other components that may be present include preservatives, stabilizers, and the like.

Packaging of the Oligonucleotide Formulations and Delivery Devices

The units dosage ampules, multidose containers, and/or delivery devices (e.g., patches) in which the oligonucleotides are packaged prior to use may comprise an hermetically sealed container enclosing an amount of oligonucleotide or oligonucleotide formulation containing a oligonucleotide suitable for a pharmaceutically effective dose thereof, or multiples of an effective dose. The oligonucleotide is preferably packaged as a sterile formulation, and the hermetically sealed container is designed to preserve sterility of the formulation until use. Where the oligonucleotides are provided in a patch-style delivery device, the patches may be contained in a strip of individually separable packaged patches for ease in dispensing.

The container in which the oligonucleotide formulation and/or delivery device is packaged is labeled, and the label bears a notice in the form prescribed by any appropriate governmental agency. For example, where the oligonucleotides are to be administered to humans, the package comprises a notice that reflects approval by the Food and Drug Administration under the applicable federal law, of the manufacture, use, or sale of the oligonucleotide material therein for human administration. Federal law requires that the use of pharmaceutical agents in the therapy of humans be approved by an agency of the Federal government. Responsibility for enforcement is the responsibility of the Food and Drug Administration, which issues appropriate regulations for securing such approval, detailed in 21 U.S.C. 301-392. Regulation for biologic material, comprising products made from the tissues of animals is provided under 42 U.S.C 262. Similar approval is required by most foreign countries. Regulations vary from country to country, but the individual procedures are well known to those in the art.

Introduction of Oligonucleotides into Skin Cells According to the Method of the Invention Application of the Oligonucleotide to Skin Administration of the oligonucleotide is accomplished by contacting a oligonucleotide-comprising formulation (e.g., a buffered salt solution comprising the oligonucleotide) with an area of skin for a time sufficient to allow genetic alteration of skin cells. Preferably, the oligonucleotide is applied to hirsute skin. The oligonucleotide can be applied to skin without substantial pretreatment or with pretreatment, preferably without pretreatment of the skin. "Pretreatment" can generally encompass removal of hair from the skin, increasing skin permeability by mechanical means (e.g, abrasion), increasing skin permeability by application of a chemical agent to the site either before or during oligonucleotide administration, and application of an irritant or other like chemical agent to elicit a non-specific immune response or an immune response toward the irritant (e.g., by application of a keratinolytic agent). Administration of the oligonucleotide can be accomplished according to the invention without the application of an electric field or electric pulse (e.g., as in iontophoresis), without breaking the skin (e.g., by abrasion or through use of a needle), and without application of pressure to the site of administration (e.g., via jet propulsion, pressurized air, etc.). Furthermore, oligonucleotide administration can be accomplished using a oligonucleotide formulation that is substantially free of permeabilizing agents, detergents, or other chemical agents that facilitate entry of the oligonucleotide into the skin.

Once the oligonucleotide-comprising formulation is brought into contact with skin, contact is maintained for a time sufficient to allow movement of the oligonucleotide from the formulation into skin and into skin cells. In general, the time of contact between the oligonucleotide and the skin will be at least about 1 min to about 1 hr or more, preferably at least about 30 min. Because there is substantially no toxicity associated with contacting the oligonucleotide with the skin, the time of contact maintained between the oligonucleotide and the skin to which the oligonucleotide is to be delivered is limited only by such factors as the ability to keep the oligonucleotide in a suitable delivery form (e.g., a time during which the oligonucleotide-comprising solution can be prevented from dehydrating) and the ability to physically maintain contact between the oligonucleotide and the site of delivery (e.g., maintenance of a patch comprising the oligonucleotide(s) on the skin). Therefore, the time of contact of a single dose can be as long as several hours to several days, and may be weeks or more. Furthermore, the time of delivery can be further extended by additional subsequent applications of the oligonucleotide to the same or different delivery site on the skin.

While an ethanolic/propylene glycol solution of anti-hairless oligonucleotide as found to deliver beneficial amounts of oligonucleotide to the hair follicle and result in inhibition of hairless, other formulations can also advantageously be used. In particular, liposome compositions can be advantageous. Liposomes were introduced first in about 1980 for topical drug delivery and have since attracted considerable interest due to their potential utility both as a drug carrier and a reservoir for controlled release of drugs within various layers of the skin and the hair follicle. In addition to reducing the undesirable high systemic absorption of topically applied drugs, the major advantage of liposomes compared to other formulations such as ointments or creams, is based on their ability to create a depot, from which the drug is slowly released. The delivery agents also provide advantages in that they protect oligonucleotides against degradation, increase cellular uptake, and may target the drug to specific cells or tissue compartment. Thus, a delivery system allowing the controlled and sustained release of oligonucleotides in vivo can greatly increase the efficacy of gene inhibition technology.

One of the most favored sites of liposome penetration is into the hair follicle, since the hair canal opens directly onto the surface of the skin. Liposomes applied to cultured hair follicles are easily detected in cells lining the inner root sheath. (Li et al., 1992b, *In Vitro Cell Dev Biol* 28A:679-681.) Liposomes also find their way into the pilosebaceous unit once traveling down the root sheath. (Lieb et al. 1992, *J Invest Dermatol* 99:108-113.) Liposomes have been shown to direct compounds into the sebaceous gland, when they would otherwise be trapped in the stratum corneum. (Bernard et al., 1997, *J Pharm Sci* 86:573-578.) Liposomes function both as a controlled release system and as a delivery system transporting encapsulated substances into cells. After topical application, and upon drying, the liposomes develop into a structured film that fills the follicular openings, intimately mixing with the follicular contents, and fostering drug diffusion to the depths of the follicles.

A number of different compositions of liposomes have been tested for in vivo oligonucleotide delivery. For example, three different lipids were compared: N-[1-(2,3-dioleoyloxy)propyl]-N,N,N-trimethyl ammonium chloride (DOTMA), 2,3-dioleyloxy-N-[2(sperminecarboxamido) ethyl]-N,N-dimethyl-1-propanaminium trifluoroacetate (DOSPA) and N-(1-(2,3-dimyristyloxypropyl)-N,N dimethyl-(2-hydroxyethyl) ammonium bromide (DMRIE). The macrophages incorporated tenfold more oligonucleotide when delivered in conjunction with DOSPA than with the other cationic lipids.

Liposome preparation and encapsulation of oligonucleotides are available from commercial manufacturer, e.g., Bio-Zone Laboratories, Inc. Pittsburg, Calif., which manufactures a wide range of topically applied LipoCeutical products that include cationic lipids.

In addition to cationic lipid liposomes, other types of liposomes can also be used, e.g. pH-sensitive liposomes. The cellular uptake of liposomes passes mainly through an endocytic pathway, and occasionally, liposomes and their contents inadvertently arrive in the lysosomes where they are degraded. The quantity of oligonucleotides that can avoid degradation and reach their nuclear or cytoplasmic target is probably very low. To overcome lysosomal degradation and in order to increase the efficiency of delivery, pH sensitive fusogenic liposomes have been used. These consist of a non-bilayer-forming lipid such as dioleylphosphatidylethanolamine (DOPE) and a titratable acidic amphiphile such as oleic acid (OA) or cholesterylhemisuccinate (CHEMS). (DeOliveira et al., 1998, *Biochim. Biophys. Acta Biomembr.* 1372: 301-310.) At pH 7, the amphiphile maintains the lipid mix in a bilayer (liposome) structure. However, as the complex moves through the endosomes, the pH drops and the amphiphile becomes protonated. This causes the liposome to collapse resulting in fusion with the endosomal membrane and release of the liposome contents into the cytoplasm. However, the anionic nature of pH-sensitive liposomes may lead to poor encapsulation of ODNs. (Hughes et al., 2000, *Methods Enzymol* 313:342-358.).

As one alternative to liposomes, other carriers/delivery agents can be used, such as cationic polymers. The most widely studied polymers are polylactides and co-polymers of lactic acid and glycolic acid P(LA-GA) and both of these have been evaluated for the use for delivery of oligonucleotides. (Lewis et al., 1998, *J Drug Target* 5:291-302; Hudson et al., 1999, *Int J Pharm* 182:49-58.)

In addition to the above, certain patents have described methods for delivery that can be used in the present invention. Examples include the following.

Li and Lishko, U.S. Pat. No. 5,914,126 (incorporated herein by reference in its entirety) describes methods to deliver macromolecules to hair follicles, where the method involves applying to the skin a formulation that includes a macromolecule, such as a nucleic acid, in a liposomal formulation, such that the liposomes target the macromolecule selectively into hair follicle cells by transfer into the follicle without entry into the circulation of the adjacent skin tissue.

Khavari et al., U.S. Pat. No. 6,087,341 (incorporated herein by reference in its entirety) describes methods and compositions for introduction of nucleic acid into skin cells by topical application.

Li and Baranov, U.S. Pat. No. 6,080,127 (incorporated herein by reference in its entirety) describes a skin vibration method for topical targeted delivery of beneficial agents into hair follicles. The vibration frequency can, for example, be about 1 Hz to 100 Hz.

In some applications, it may be useful to include transdermal penetration enhancers, for example, as described in Karande et al., 2004, *Nature Biotech.* 192-197. As described, two types of compositions were particularly effective. One included sodium laureth sulfate (SLA) with phenyl piperazine (PP). In a particular composition the SLA:PP was as 0.5% (w/v) with the weight ration of SLA=0.7 in the combination. The second included N-lauroyl sarcosine (NLS) with sorbitan monolaurate (S20). In a particular composition, the combination was at 1.0% (w/v) with the weight ration of NLS=0.6.

G. Administration

The present compositions can be administered in various ways, e.g., depending on the condition to be treated, and the type of composition to be used. In many cases, topical administration will be used. This mode of administration is particularly suitable for local hair removal.

In some applications, hair removal is desired in only a portion of the skin area of a subject. In those cases, the composition can be applied locally.

Exemplary Topical Application Methods

Spreading

In most cases, the composition containing the RNAi inducing oligonucleotides will be spread or wiped on the treatment area to form a thin film. Thus, for example, for any of the forms of liquid suspension or solution, cream, lotion, gel, or ointment, a quantity of the composition is spread on the treatment surface or surfaces of the subject, and left for a time to allow oligonucleotides (which may be in a carrier species such as in liposomes, to migrate to the hair follicles.

Spraying

For compositions that are sufficiently liquid, the composition can be sprayed on the treatment site, either with or without protection against overspray on surrounding areas. For spray applications, it may be desirable to protect against inhalation of sprayed material, e.g., by using masks that will filter out the relevant sized aerosol particles.

Injection

In some applications, it will be desirable to remove only specific hairs. Thus, rather than contacting a particular area, a composition will be delivered to one or more particular hair follicles. Such individual follicle delivery can be accomplished in various ways. For example, a drop of liquid containing the active oligonucleotide(s) can be deposited on the hair shaft, and allowed to migrate down the shaft to the follicle. In another approach, a needle can be inserted in the hair channel, and liquid or other composition deposited at or near the follicle.

Application Site Preparation and Hair Cycle Synchronization

In some cases, the present compositions can be applied without any special preparation of the application site. In other cases, however, it is advantageous to prepare the site, e.g., by preliminary removal of hair from the site and/or to combine the present invention with a supplementary method of hair removal. Such removal can be beneficial in several different ways. For example, such removal can reduce the amount of active agent required for the present invention because the material will not be lost by adhering to the hair, and instead will be available for absorption/migration to the hair follicles.

Such removal can also be beneficially be used to supplement the present invention by removing residual hairs. Depending on the manner and amount of RNAi inducing oligonucleotide delivered to the hair follicles, some of the follicles may not be sufficiently inhibited, such that some hairs may grow in the treated area and/or some hairs may be reduced in thickness or length but still present. In such cases, a supplementary method of hair removal can be used to produce a desired level of hair removal, e.g., shaving, chemical depilation, enzymatic hair removal; laser treatment; electrolysis. Certain embodiments of the present invention include such an supplemental method.

It can also be advantageous to synchronize hair cycles in the treatment area. Such synchronization can advantageously be done prior to application of the present compositions, or during an interval of treatment with the present compositions, or in an interval between two occasions or intervals of application of the present compositions.

Such synchronization can be accomplished, for example, by pulling hairs from the follicles (either individually or in larger numbers). Examples of methods for pulling the hairs include plucking and waxing. In some circumstances it will be necessary/desirable to induce follicle synchrony by molecular means. In these instances, skin is treated with a known follicle growth inducer such as cyclosporin A, TPA, Noggin, estrogen receptor agonist, and the like.

In general, if a hair is pulled from a follicle in anagen, that follicle goes into catagen; if a hair is pulled from a follicle in telogen, the follicle is stimulated to produce hair, and thus goes into anagen. Thus, for a more extensive effect using the present invention, a distribution of hairs in anagen, catagen, and telogen can be synchronized in catagen, with one pulling to push anagen follicles to catagen, and two pullings to stimulate telegen follicles to anagen, and then push the newly anagen follicles to catagen. Depending on the reaction of the follicles, such procedure can produce a single phase synchrony, or a two phase synchrony.

EXAMPLE 1

In Vitro siRNA Inhibition of Hairless mRNA siRNAs were commercially obtained from Ambion, Inc. for human and mouse hairless genes. These are validated, chemically synthesized siRNAs, that are HPLC purified, annealed and ready to use, and guaranteed to reduce target gene expression by 70% or more. For both human and mouse transcripts, two different siRNAs were used. The sequence of the hairless siRNAs is given in the following table. In this and the subsequent tables in this example, upper case letter are used to refer to the human homologs, and lower case letter refer to the mouse homologs of the specified genes.
List of Pre-Designed siRNAs Used for Gene Silencing Experiments.

| siRNA | Sense Sequence | Antisense Sequence |
|---|---|---|
| HR#1 | 5'-GGACAUGCUCCCACUUGUGtt-3' (SEQ ID NO: 11355) | 5'-CACAAGUGGGAGCAUGUCCtt-3' (SEQ ID NO: 11356) |
| HR#2 | 5'-GGAGGCCAUGCUUACCCAUtt-3' (SEQ ID NO: 11357) | 5'-AUGGGUAAGCAUGGCCUCCtt-3' (SEQ ID NO: 11358) |
| hr#1 | 5'-GGACACACUCUCACUGGUGtt-3' (SEQ ID NO: 11359) | 5'-CACCAGUGAGAGUGUGUCCtt-3' (SEQ ID NO: 11360) |
| hr#2 | 5'-GGGCUUUUACCACAAGGAUtt-3' (SEQ ID NO: 11361) | 5'-AUCCUUGUGGUAAAAGCCCtt-3' (SEQ ID NO: 11362) |

We also used siRNAs for the mouse glyceraldehyde-3-phosphate dehydrogenase (gapdh) gene, Silencer™ GAPDH siRNA (Cat no. 4605, Ambion, Inc. Austin, Tex.) as controls to monitor and optimize siRNA experiments.

Human HaCaT, HeLa and mouse NIH 3T3 cells were used in siRNA transfection experiments. Cells were plated on 6-well tissue culture plates in Dulbecco's Modified Eagle Media (D-MEM, Cat no. 10569-010, Invitrogen Corp., Carlsbad, Calif.) with 10% Fetal Bovine Serum (Cat no. 16000-044, Invitrogen, Corp.) so that they were 30-50% confluent at the time of transfection. Immediately before the transfection, the cells were washed in Opti-MEM I Reduced Serum Medium (Cat no. 31985-070, Invitrogen, Inc.). We used 200 μmol of short interfering RNA (siRNA) for each well and the Oligofectamine™ reagent. The transfections were performed according to the manufacturer's instructions (Cat no. 12252-011, Invitrogen, Inc).

Total RNA was isolated 24 and 48 hours post-transfection using the RNeasy Mini Kit (Cat no. 74104, QIAGEN, Inc., Valencia, Calif.) according to the manufacturer's instructions. cDNA synthesis was performed using the SuperScript First-Strand Synthesis System for RT-PCR kit (Cat no. 11904-018, Invitrogen, Corp.) and oligo (dT) primers. Gene activity was determined by the Real-Time quantitative RT-PCR (qRT-PCR) technique.

Real Time Quantitative RT-PCR (qRT-PCR)

Real-Time qRT-PCR was performed using MJ Research Opticon 2 continuous fluorescence detector. For qRT-PCR 40 ng of cDNA obtained from cultured HaCaT, HeLa, and NIH3T3 cells (siRNA treated and untreated), was amplified using the MJ Research DyNAmo Hot Start SYBR Green qPCR kit (Cat no. F-410L, MJ Research, Inc., Waltham, Mass. The DyNAmo Hot Start SYBR Green qPCR kit is a master mix of a modified hot start DNA polymerase with SYBR Green I and the appropriate buffers, all of which have been optimized for real-time quantitative analysis with the MJ Research Opticon 2. PCR amplification of cDNA samples was performed in 96 well optical plates under the following conditions:

| | |
|---|---|
| 1. | Incubate at 95.0 C. for 00:10:00 |
| 2. | Incubate at 95.0 C. for 00:00:20 |
| 3. | Incubate at 55.0 C. for 00:00:30 |
| 4. | Incubate at 72.0 C. for 00:00:40 |
| 5. | Plate Read |
| 6. | Incubate at 77.0 C. for 00:00:01 |
| 7. | Plate Read |
| 8. | Go to line 3 for 39 more times |

-continued

| | |
|---|---|
| 9. | Incubate at 72.0 C. for 00:05:00 |
| 10. | Melting Curve from 65.0 C. to 95.0 C. read every 0.2 C. hold 00:00:01 |
| 11. | Incubate at 72.0 C. for 00:05:00 |
| | END |

The list of PCR primers used for Real Time PCR amplifications is given in the following table.

PCR primers used for Real-Time RT-PCR amplifications of mouse and human hairless, mouse glyceraldehyde-3-phosphate dehydrogenase gene, and hypoxanthine guanine phosphoriboxyltransferase 1 (hprt). (HPRT was used as a normalizing internal control in mouse cells the same way GAPDH was used for the human cell lines.)

| Gene | Forward primer | Reverse primer |
|---|---|---|
| Hr | 5'-TTCTACCGCGGTCAAACTCT-3' (SEQ ID NO: 11363) | 5'-TTGGTGTCAGGGATCCAAAG-3' (SEQ ID NO: 11364) |
| GAPDH | 5'-AGCCACATCGCTCAGAACAC-3' (SEQ ID NO: 11365) | 5'-GAGGCATTGCTGATGATCTTG-3' (SEQ ID NO: 11366) |
| hr | 5'-ACATCAAAGAAGAGACCCCAG-3' (SEQ ID NO: 11367) | 5'-TTCGCACTGGTGACAATGGAA-3' (SEQ ID NO: 11368) |
| gapdh | 5'-GTGAACGGATTTGGCCGTATT-3' (SEQ ID NO: 11369) | 5'-TTTTGGCTCCACCCTTCAAGT-3' (SEQ ID NO: 11370) |
| hplt | 5'-CCCTGGTTAAGCAGTACAGC-3' (SEQ ID NO: 11371) | 5'-CAGGACTAGAACACCTGCTAA-3' (SEQ ID NO: 11372) |

Plate readings for fluorescence levels are taken at two steps, 5 and 7. These values indicate the relative amounts of amplicon per well at a particular cycle. The raw numbers obtained from these readings were used to determine the PCR amplification efficiency. This is the measurement of fold amplification per PCR cycle, and is expressed as a fraction or percentage relative to perfect doubling. A PCR resulting in perfect doubling would exhibit 100% amplification efficiency. All of the calculations are done using the LinRegPCR program by J. M. Ruijter and C. Ramakers. The crossing threshold for the experiment is determined manually and is defined at the cycle at which amplification for all samples becomes logarithmic. The relative fold for each amplicon is then determined using the amplification efficiency and crossing threshold for that particular amplicon and normalizing it against the relative starting amounts, which is determined by the GAPDH amplification efficiency and crossing threshold that corresponds to that sample. This is done using parameters and equations set by Lui and Saint (Analytical Biochemistry 302, 52-59 (2002)). The final values can then be used to compare the fold differences in gene expression of a particular gene across several different samples or conditions.

This technique and analysis can be applied to determine the levels of hairless expression, or more specifically, the efficiency of gene silencing using hairless siRNA through comparison of the treated and untreated cell populations.

The following table shows the percentage of gene silencing observed following siRNA treatment of human HeLa and HaCaT cells. Total RNA was collected 48 hours following transfection with siRNAs for hairless (Hr) gene. Gene activity was assayed by real-time quantitative RT-PCR (qRT-PCR) technique. Percent knockdown is calculated by obtaining the ratio of the normalized level of Hr expression in treated and untreated cell populations and subtracting this value from 1 (100% expression).

| siRNA | Gene Expression Tested | Cell Type | Percent Knockdown | RNA isolation time point |
|---|---|---|---|---|
| HR#1 | Hr | HeLa | 97.3% | 48 hours |
| HR#2 | Hr | HeLa | 98.7% | 48 hours |
| HR#2 | Hr | HaCaT | 95.8% | 48 hours |

The following table shows the percentage of gene silencing observed following siRNA treatment of mouse NIH3T3 cells. Total RNA was collected 48 hours following transfection with siRNAs for hairless (hr) and glyceraldehyde-3-phosphate dehydrogenase (gpdh) genes. Gene activity was assayed by real-time quantitative RT-PCR (qRT-PCR) technique. Percent knockdown is calculated by obtaining the ratio of the normalized level of hr and gapdh expression in treated and untreated cell populations and subtracting this value from 1 (100% expression).

| siRNA | Gene Expression Tested | Cell Type | Percent Knockdown | RNA isolation time point |
|---|---|---|---|---|
| hr#1 | Hr | NIH3T3 | 99.3% | 48 hours |
| hr#2 | Hr | NIH3T3 | 99.17% | 48 hours |
| Gapdh | Gapdh | NIH3T3 | 99.3% | 48 hours |

EXAMPLE 2

In Vivo Testing: A Phase 1 Clinical Trial of Anti-Hairless siRNA

The goal of this study is to establish the safety of topical application of anti-hairless siRNA (Trichozyme) in healthy human subjects at a dose of 10 µg daily, administered over a period of 3 months.

Inhibition of gene expression using or siRNA technology is a recently developing area of therapy. Several recent studies indicate the usefulness of such therapeutic strategies in a number of different conditions. Our preliminary in vivo studies demonstrated the inhibition of hairless mRNA can be used to permanently inhibit hair growth in experimental animals. Briefly, they inhibit translation from the mRNA transcript originating from the human hairless gene, the first known gene participating in the regulation of the human hair cycle as identified by our group earlier, preventing the synthesis of functional hairless protein. Presence of hairless protein is necessary for uninterrupted hair cycling, and lack of hairless gene expression due to a deleterious mutation or temporary inhibition leads to a permanent inhibition of hair growth and the involution of hair follicles as evidenced by our own in vivo trials in animal models. The successful translation of the result of animal studies to human application leads to a strategy to obtain permanent inhibition of hair growth by temporary topical treatment with Trichozyme.

Study Design

This will be an open label, uncontrolled, safety study. Monitoring for side effects, alterations in hematology, serum chemistries and urine analysis will continue during the 3 month treatment period as well as during the 6 month follow up period after the application is stopped. Subjects will be seen daily by Study personnel during the treatment period and monthly during the follow-up period. The Study will not offer treatment of any side effects that develop.

We will enlist 20 subjects, 10 of which will be treated with the siRNA in an isopropranol or liposomal based vehicle, the other 10 subject will receive treatment with vehicle only. Hair from the dorsal surface of the left forearm will be removed by waxing before applying treatment during the first 30 days of the study. Treatment will consist of topical application of an isopropranol based solution alone or containing anti-hairless siRNA over a 15 cm² area of the dorsal surface of the left forearm using a glass rod. Ample time will be left for absorption.

Subjective side effects, alterations in serum chemistry, hematology and urine analysis will be monitored as well as serum and urine isopropranol level and presence of Trichozymes in serum and urine samples. Photography of the treatment area and hair count will be performed during the initial visit and weekly afterwards during the treatment period of the study then monthly during the follow-up period of the study.

Study Procedures

Before entering in the study subjects will sign an informed consent for disclosure of medical records. A screening questionnaire will be completed as well as a review of medical records to exclude any preexisting medical conditions affecting hair growth or other preexisting diseases listed as exclusion criteria.

Laboratory evaluation—Fasting blood and urine samples will be obtained for the following tests: (a) Hematology—hemoglobin and hematocrit, CBC with differential and platelet count, (b) Serum Chemistry—sodium, total bilirubin, potassium, glucose, chloride, alkaline phosphatase, calcium, AST, ALT, inorganic phosphorus, BUN, creatinine, bicarbonate; (c) urinalysis—protein, glucose, pH, Ketones, nitrates, blood (d.) pregnancy test.

Screening/Baseline Visit—Informed consent for study participation signed. Complete history (including record of systemic and topical medication, both prescription and non-prescription). Physical exam—Comprehensive skin exam and photography of the treatment area and hair count. (e) Review criteria for inclusion/exclusion and determine eligibility.

Daily Clinic Visits for treatment—waxing of the treatment area (for first 30 days only) followed by topical application of Treatment. Blood and urine samples for Hematology, Serum chemistry, Urine analysis, Isporopranol serum/urine level and siRNA detection in serum/urine will be obtained monthly. Photography of the treatment area and hair count will be performed weekly. Subjects will be interviewed for subjective side effects weekly.

Monthly Clinic Visits for follow-up—Blood and urine samples for Hematology, Serum chemistry, Urine analysis, Isporopranol serum/urine level and siRNA detection in serum/urine will be obtained. Photography of the treatment area and hair count. Subjects will be interviewed for subjective side effects.

Study Site—Subjects will be seen at the clinical facilities for the study.

Study Drugs siRNAs for the study are are oligonucleotides with RNAi activity that is specific to mRNA sequences present in the human hairless mRNA. This study will utilize a mixture of 8-10 different siRNAs. To date there is no data available of topical cutaneous application of any deoxy-ribozymes. The siRNAs to be used in this study will be provided by a manufacturer offering custom synthesized human grade oligonucleotides.

Study Questionnaires

All subjects will complete study questionnaires at baseline.

Study Subjects

Criteria—Inclusion—(i) Study subjects must be 18 to 35 years of age, female of Hispanic ethnicity. (ii) Have no previous medical history of hair growth abnormalities or endocrine, renal, autoimmune, cardiac, pulmonary, hematological or psychiatric disorders. (iii) Other inclusion criteria: (iv) The subject has provided written informed consent prior to administration of any study-related procedures. (v) The subject has been using adequate contraception since her last menses and will use adequate contraception during the study, is not lactating, and has a documented negative serum pregnancy test within 14 days prior to the first dose of study medication. (vi) The subject is willing to abstain from any voluntary alteration of body hair of the treated area. (vii) The subject is willing to abstain from application of prescription and over the counter topical medications for the duration of the study, including moisturizers, emollients and sunscreens. (viii) The subject is willing to return for scheduled follow-up visits for the duration of the study. (ix) The subject must meet the following laboratory criteria during a time not to exceed 8 weeks prior to randomization: 1) hemoglobin level of greater than 12.0 (women) or 13.0 (men); 2) WBC count greater than 3000/mm³; 3) platelet count greater than 125,000; 4) BUN within normal limits; 5) electrolytes within normal limits; 6) creatinine≦1.5×ULN; 7) AST≦1.5×ULN; 8) ALT≦1.5×ULN; 9) total bilirubin within normal limits; and 10) creatinin clearance within normal limits.

Exclusion—(i) existence of any medical conditions listed above. (ii) any laboratory values that do not meet the criteria listed above. (iii) Pregnancy or lactation. (iv) Invasive cancer or anticipated hormonal, chemo-, or radiotherapy while participating in the study. (v) Any medical or psychosocial condition that, in the opinion of the investigator, could jeopardize subject's participation in this study.

Recruitment of Subjects

Potential subjects for this Study will be recruited from among residents in proximity to the study site because of the daily visit requirements. Subjects with Hispanic ethnicity will be recruited to avoid inter-ethnicity variations of hair density and follicle site as well as blonde hair that is less appropriate for complete hair count and photography.

EXAMPLE 3

Hair Removal Using In Vivo Knockdown of Hairless mRNA

It was demonstrated that inhibiting the expression of hairless mRNA in an animal model system created essentially a hairless condition. This exemplary test was conducted using ribozymes targeting the hairless mRNA, and is described in Cserhalmi-Friedman et al., *Exp Dermatol.*, 2004 March; 13(3):155-62, which is incorporated herein by reference in its entirety.

Short Term Results in Newborn Mice

The mice, who were gender-matched littermates, were sacrificed after four weeks of treatment that started immediately after the animals were born. All treated mice demonstrated a variable degree of visible sparseness of hair at the treated area of the back, which was not observed in the control animals treated with nonspecific deoxyribozymes. The specimens taken from the control animal show the presence of large number of hair follicles in anagen V stage, corresponding to the clinical appearance. In contrast, the samples taken from the treated mice demonstrate the presence of smaller hair follicles with morphological features similar to those observed in anagen III stage (i.e.: hair shaft did not reach the level of the sebaceous gland). A large portion of the hair follicles in the treated region showed delayed anagen development as well as significant dilatation of the hair canal, reminiscent of utricles characteristic of the hairless phenotype. In these samples, we observed several large cysts filled with keratinous material and remnants of coiled and degraded hair follicles. These dermal cysts are believed to be the result of hair follicle disintegration and abnormal hair shaft formation. Importantly, dermal cysts are hallmark features of the hairless phenotype and usually contain either keratinous mass or a degraded hair shaft, as seen in the sample taken from the skin of a hairless mouse. The inhibition of hair growth, formation of the utriculi, and appearance of dermal cysts were present in all treated mice, but were not detected in any control animals.

b. Long Term Results in Newborn Mice

Another group of littermates of identical gender was sacrificed after seven weeks of treatment that started immediately after the animals were born. A noticeable decrease in the density of hair was present in the treated animals as compared to the control mice treated with on specific deoxyribozymes. The sample from the control animals showed the presence of regularly spaced telogen hair follicles. In the treated area, we observed a significantly decreased number of follicles with large areas of the skin devoid of any hair follicles at all. In the treated area, we detected the presence of large cysts filled with amorphous keratin material, corresponding to dermal cysts, which are characteristics of the hairless phenotype. Histopathology of the treated area showed the presence of small dense groups of cells with condensed nuclei in the deep dermis. These cell groups were reminiscent of detached dermal papillae, which are typically found in hairless mice. The lack of hair follicles, the presence of dermal cysts and the detached dermal papillae were present in every treated animal, while all the control animals showed the presence of evenly spaced telogen follicles.

c. Results in Depilated Animals

This group of eight week old female littermates was wax-depilated and subsequently sacrificed after four weeks of treatment that began immediately after the depilation. Clinically, the control animals showed active hair regrowth in the depilated area.

In contrast, the hair regrowth was of lesser magnitude in the treated mice, and the hair became sparse (not shown). Histopathology of the control mouse skin shows the presence of a large number of hair follicles in advanced anagen. In the samples taken from the treated animals, the treated regions could be easily identified by the lack of depilation-induced hair regrowth. These untreated hair follicles were identical to those observed in the control animals treated with nonspecific deoxyribozymes. On histology, the treated area with small telogen hair follicles could be easily distinguished from neighboring untreated area with hair follicles at advanced anagen stages, suggesting that in the treated portion of skin the hair follicles were not able to enter depilation-induced anagen at all, or exhibited much lower growth rates compare to control skin.

All patents and other references cited in the specification are indicative of the level of skill of those skilled in the art to which the invention pertains, and are incorporated by reference in their entireties, including any tables and figures, to the same extent as if each reference had been incorporated by reference in its entirety individually.

One skilled in the art would readily appreciate that the present invention is well adapted to obtain the ends and advantages mentioned, as well as those inherent therein. The methods, variances, and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications may be made to the invention disclosed herein without departing from the scope and spirit of the invention. For example, variations can be made to the number, length, and chemical modifications in the dsRNA. Thus, such additional embodiments are within the scope of the present invention and the following claims.

The invention illustratively described herein suitably may be practiced in the absence of any element or elements, limitation or limitations which is not specifically disclosed herein. Thus, for example, in each instance herein any of the terms "comprising", "consisting essentially of" and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the concepts herein disclosed may be resorted to by those skilled in the art, and that such modifications and variations are considered to be within the scope of this invention as defined by the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

Also, unless indicated to the contrary, where various numerical values are provided for embodiments, additional embodiments are described by taking any 2 different values as the endpoints of a range. Such ranges are also within the scope of the described invention.

Thus, additional embodiments are within the scope of the invention and within the following claims.

TABLE 1 cDNA Human Hairless 19-mer Target Sequences and Complement Referenced to NM_005144- Homo sapiens hairless homolog (mouse) (HR), transcript variant 1, complete mRNA (1-5699 bp). (SEQ ID NO: for Sense equals (2X - 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1 | TCTCCCGGGAGCCACTCCC | GGGAGTGGCTCCCGGGAGA |
| 2 | CTCCCGGGAGCCACTCCCA | TGGGAGTGGCTCCCGGGAG |
| 3 | TCCCGGGAGCCACTCCCAT | ATGGGAGTGGCTCCCGGGA |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 4 | CCCGGGAGCCACTCCCATG | CATGGGAGTGGCTCCCGGG |
| 5 | CCGGGAGCCACTCCCATGG | CCATGGGAGTGGCTCCCGG |
| 6 | CGGGAGCCACTCCCATGGG | CCCATGGGAGTGGCTCCCG |
| 7 | GGGAGCCACTCCCATGGGC | GCCCATGGGAGTGGCTCCC |
| 8 | GGAGCCACTCCCATGGGCG | CGCCCATGGGAGTGGCTCC |
| 9 | GAGCCACTCCCATGGGCGC | GCGCCCATGGGAGTGGCTC |
| 10 | AGCCACTCCCATGGGCGCC | GGCGCCCATGGGAGTGGCT |
| 11 | GCCACTCCCATGGGCGCCT | AGGCGCCCATGGGAGTGGC |
| 12 | CCACTCCCATGGGCGCCTC | GAGGCGCCCATGGGAGTGG |
| 13 | CACTCCCATGGGCGCCTCT | AGAGGCGCCCATGGGAGTG |
| 14 | ACTCCCATGGGCGCCTCTC | GAGAGGCGCCCATGGGAGT |
| 15 | CTCCCATGGGCGCCTCTCC | GGAGAGGCGCCCATGGGAG |
| 16 | TCCCATGGGCGCCTCTCCA | TGGAGAGGCGCCCATGGGA |
| 17 | CCCATGGGCGCCTCTCCAG | CTGGAGAGGCGCCCATGGG |
| 18 | CCATGGGCGCCTCTCCAGC | GCTGGAGAGGCGCCCATGG |
| 19 | CATGGGCGCCTCTCCAGCC | GGCTGGAGAGGCGCCCATG |
| 20 | ATGGGCGCCTCTCCAGCCC | GGGCTGGAGAGGCGCCGAT |
| 21 | TGGGCGCCTCTCCAGCCCC | GGGGCTGGAGAGGCGCCCA |
| 22 | GGGCGCCTCTCCAGCCCCT | AGGGGCTGGAGAGGCGCCC |
| 23 | GGCGCCTCTCCAGCCCCTG | CAGGGGCTGGAGAGGCGCC |
| 24 | GCGCCTCTCCAGCCCCTGG | CCAGGGGCTGGAGAGGCGC |
| 25 | CGCCTCTCCAGCCCCTGGC | GCCAGGGGCTGGAGAGGCG |
| 26 | GCCTCTCCAGCCCCTGGCC | GGCCAGGGGCTGGAGAGGC |
| 27 | CCTCTCCAGCCCCTGGCCT | AGGCCAGGGGCTGGAGAGG |
| 28 | CTCTCCAGCCCCTGGCCTG | CAGGCCAGGGGCTGGAGAG |
| 29 | TCTCCAGCCCCTGGCCTGG | CCAGGCCAGGGGCTGGAGA |
| 30 | CTCCAGCCCCTGGCCTGGA | TCCAGGCCAGGGGCTGGAG |
| 31 | TCCAGCCCCTGGCCTGGAA | TTCCAGGCCAGGGGCTGGA |
| 32 | CCAGCCCCTGGCCTGGAAG | CTTCCAGGCCAGGGGCTGG |
| 33 | CAGCCCCTGGCCTGGAAGC | GCTTCCAGGCCAGGGGCTG |
| 34 | AGCCCCTGGCCTGGAAGCA | TGCTTCCAGGCCAGGGGCT |
| 35 | GCCCCTGGCCTGGAAGCAC | GTGCTTCCAGGCCAGGGGC |
| 36 | CCCCTGGCCTGGAAGCACC | GGTGCTTCCAGGCCAGGGG |
| 37 | CCCTGGCCTGGAAGCACCA | TGGTGCTTCCAGGCCAGGG |
| 38 | CCTGGCCTGGAAGCACCAG | CTGGTGCTTCCAGGCCAGG |
| 39 | CTGGCCTGGAAGCACCAGG | CCTGGTGCTTCCAGGCCAG |
| 40 | TGGCCTGGAAGCACCAGGA | TCCTGGTGCTTCCAGGCCA |
| 41 | GGCCTGGAAGCACCAGGAA | TTCCTGGTGCTTCCAGGCC |
| 42 | GCCTGGAAGCACCAGGAAC | GTTCCTGGTGCTTCCAGGC |
| 43 | CCTGGAAGCACCAGGAACC | GGTTCCTGGTGCTTCCAGG |
| 44 | CTGGAAGCACCAGGAACCC | GGGTTCCTGGTGCTTCCAG |
| 45 | TGGAAGCACCAGGAACCCT | AGGGTTCCTGGTGCTTCCA |
| 46 | GGAAGCACCAGGAACCCTG | CAGGGTTCCTGGTGCTTCC |
| 47 | GAAGCACCAGGAACCCTGG | CCAGGGTTCCTGGTGCTTC |
| 48 | AAGCACCAGGAACCCTGGG | CCCAGGGTTCCTGGTGCTT |
| 49 | AGCACCAGGAACCCTGGGG | CCCCAGGGTTCCTGGTGCT |
| 50 | GCACCAGGAACCCTGGGGA | TCCCCAGGGTTCCTGGTGC |
| 51 | CACCAGGAACCCTGGGGAT | ATCCCCAGGGTTCCTGGTG |
| 52 | ACCAGGAACCCTGGGGATG | CATCCCCAGGGTTCCTGGT |
| 53 | CCAGGAACCCTGGGGATGG | CCATCCCCAGGGTTCCTGG |
| 54 | CAGGAACCCTGGGGATGGG | CCCATCCCCAGGGTTCCTG |
| 55 | AGGAACCCTGGGGATGGGG | CCCCATCCCCAGGGTTCCT |
| 56 | GGAACCCTGGGGATGGGGC | GCCCCATCCCCAGGGTTCC |
| 57 | GAACCCTGGGGATGGGGCA | TGCCCCATCCCCAGGGTTC |
| 58 | AACCCTGGGGATGGGGCAG | CTGCCCCATCCCCAGGGTT |
| 59 | ACCCTGGGGATGGGGCAGA | TCTGCCCCATCCCCAGGGT |
| 60 | CCCTGGGGATGGGGCAGAC | GTCTGCCCCATCCCCAGGG |
| 61 | CCTGGGGATGGGGCAGACC | GGTCTGCCCCATCCCCAGG |
| 62 | CTGGGGATGGGGCAGACCC | GGGTCTGCCCCATCCCCAG |
| 63 | TGGGGATGGGGCAGACCCT | AGGGTCTGCCCCATCCCCA |
| 64 | GGGGATGGGGCAGACCCTC | GAGGGTCTGCCCCATCCCC |
| 65 | GGGATGGGGCAGACCCTCA | TGAGGGTCTGCCCCATCCC |
| 66 | GGATGGGGCAGACCCTCAC | GTGAGGGTCTGCCCCATCC |
| 67 | GATGGGGCAGACCCTCACA | TGTGAGGGTCTGCCCCATC |
| 68 | ATGGGGCAGACCCTCACAG | CTGTGAGGGTCTGCCCCAT |
| 69 | TGGGGCAGACCCTCACAGC | GCTGTGAGGGTCTGCCCCA |
| 70 | GGGGCAGACCCTCACAGCC | GGCTGTGAGGGTCTGCCCC |
| 71 | GGGCAGACCCTCACAGCCC | GGGCTGTGAGGGTCTGCCC |
| 72 | GGCAGACCCTCACAGCCCG | CGGGCTGTGAGGGTCTGCC |

TABLE 1-continued cDNA Human Hairless 19-mer Target Sequences and Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 73 | GCAGACCCTCACAGCCCGG | CCGGGCTGTGAGGGTCTGC |
| 74 | CAGACCCTCACAGCCCGGG | CCCGGGCTGTGAGGGTCTG |
| 75 | AGACCCTCACAGCCCGGGG | CCCCGGGCTGTGAGGGTCT |
| 76 | GACCCTCACAGCCCGGGGT | ACCCCGGGCTGTGAGGGTC |
| 77 | ACCCTCACAGCCCGGGGTC | GACCCCGGGCTGTGAGGGT |
| 78 | CCCTCACAGCCCGGGGTCT | AGACCCCGGGCTGTGAGGG |
| 79 | CCTCACAGCCCGGGGTCTG | CAGACCCCGGGCTGTGAGG |
| 80 | CTCACAGCCCGGGGTCTGG | CCAGACCCCGGGCTGTGAG |
| 81 | TCACAGCCCGGGGTCTGGA | TCCAGACCCCGGGCTGTGA |
| 82 | CACAGCCCGGGGTCTGGAG | CTCCAGACCCCGGGCTGTG |
| 83 | ACAGCCCGGGGTCTGGAGC | GCTCCAGACCCCGGGCTGT |
| 84 | CAGCCCGGGGTCTGGAGCC | GGCTCCAGACCCCGGGCTG |
| 85 | AGCCCGGGGTCTGGAGCCG | CGGCTCCAGACCCCGGGCT |
| 86 | GCCCGGGGTCTGGAGCCGG | CCGGCTCCAGACCCCGGGC |
| 87 | CCCGGGGTCTGGAGCCGGT | ACCGGCTCCAGACCCCGGG |
| 88 | CCGGGGTCTGGAGCCGGTG | CACCGGCTCCAGACCCCGG |
| 89 | CGGGGTCTGGAGCCGGTGT | ACACCGGCTCCAGACCCCG |
| 90 | GGGGTCTGGAGCCGGTGTC | GACACCGGCTCCAGACCCC |
| 91 | GGGTCTGGAGCCGGTGTCG | CGACACCGGCTCCAGACCC |
| 92 | GGTCTGGAGCCGGTGTCGG | CCGACACCGGCTCCAGACC |
| 93 | GTCTGGAGCCGGTGTCGGA | TCCGACACCGGCTCCAGAC |
| 94 | TCTGGAGCCGGTGTCGGAG | CTCCGACACCGGCTCCAGA |
| 95 | CTGGAGCCGGTGTCGGAGC | GCTCCGACACCGGCTCCAG |
| 96 | TGGAGCCGGTGTCGGAGCT | AGCTCCGACACCGGCTCCA |
| 97 | GGAGCCGGTGTCGGAGCTC | GAGCTCCGACACCGGCTCC |
| 98 | GAGCCGGTGTCGGAGCTCA | TGAGCTCCGACACCGGCTC |
| 99 | AGCCGGTGTCGGAGCTCAT | ATGAGCTCCGACACCGGCT |
| 100 | GCCGGTGTCGGAGCTCATC | GATGAGCTCCGACACCGGC |
| 101 | CCGGTGTCGGAGCTCATCT | AGATGAGCTCCGACACCGG |
| 102 | CGGTGTCGGAGCTCATCTG | CAGATGAGCTCCGACACCG |
| 103 | GGTGTCGGAGCTCATCTGG | CCAGATGAGCTCCGACACC |
| 104 | GTGTCGGAGCTCATCTGGG | CCCAGATGAGCTCCGACAC |
| 105 | TGTCGGAGCTCATCTGGGC | GCCCAGATGAGCTCCGACA |
| 106 | GTCGGAGCTCATCTGGGCC | GGCCCAGATGAGCTCCGAC |
| 107 | TCGGAGCTCATCTGGGCCC | GGGCCCAGATGAGCTCCGA |
| 108 | CGGAGCTCATCTGGGCCCA | TGGGCCCAGATGAGCTCCG |
| 109 | GGAGCTCATCTGGGCCCAT | ATGGGCCCAGATGAGCTCC |
| 110 | GAGCTCATCTGGGCCCATG | CATGGGCCCAGATGAGCTC |
| 111 | AGCTCATCTGGGCCCATGA | TCATGGGCCCAGATGAGCT |
| 112 | GCTCATCTGGGCCCATGAC | GTCATGGGCCCAGATGAGC |
| 113 | CTCATCTGGGCCCATGACC | GGTCATGGGCCCAGATGAG |
| 114 | TCATCTGGGCCCATGACCT | AGGTCATGGGCCCAGATGA |
| 115 | CATCTGGGCCCATGACCTC | GAGGTCATGGGCCCAGATG |
| 116 | ATCTGGGCCCATGACCTCT | AGAGGTCATGGGCCCAGAT |
| 117 | TCTGGGCCCATGACCTCTC | GAGAGGTCATGGGCCCAGA |
| 118 | CTGGGCCCATGACCTCTCC | GGAGAGGTCATGGGCCCAG |
| 119 | TGGGCCCATGACCTCTCCA | TGGAGAGGTCATGGGCCCA |
| 120 | GGGCCCATGACCTCTCCAG | CTGGAGAGGTCATGGGCCC |
| 121 | GGCCCATGACCTCTCCAGA | TCTGGAGAGGTCATGGGCC |
| 122 | GCCCATGACCTCTCCAGAC | GTCTGGAGAGGTCATGGGC |
| 123 | CCCATGACCTCTCCAGACA | TGTCTGGAGAGGTCATGGG |
| 124 | CCATGACCTCTCCAGACAT | ATGTCTGGAGAGGTCATGG |
| 125 | CATGACCTCTCCAGACATT | AATGTCTGGAGAGGTCATG |
| 126 | ATGACCTCTCCAGACATTT | AAATGTCTGGAGAGGTCAT |
| 127 | TGACCTCTCCAGACATTTG | CAAATGTCTGGAGAGGTCA |
| 128 | GACCTCTCCAGACATTTGG | CCAAATGTCTGGAGAGGTC |
| 129 | ACCTCTCCAGACATTTGGC | GCCAAATGTCTGGAGAGGT |
| 130 | CCTCTCCAGACATTTGGCA | TGCCAAATGTCTGGAGAGG |
| 131 | CTCTCCAGACATTTGGCAA | TTGCCAAATGTCTGGAGAG |
| 132 | TCTCCAGACATTTGGCAAA | TTTGCCAAATGTCTGGAGA |
| 133 | CTCCAGACATTTGGCAAAA | TTTTGCCAAATGTCTGGAG |
| 134 | TCCAGACATTTGGCAAAAT | ATTTTGCCAAATGTCTGGA |
| 135 | CCAGACATTTGGCAAAATC | GATTTTGCCAAATGTCTGG |
| 136 | CAGACATTTGGCAAAATCA | TGATTTTGCCAAATGTCTG |
| 137 | AGACATTTGGCAAAATCAA | TTGATTTTGCCAAATGTCT |
| 138 | GACATTTGGCAAAATCAAG | CTTGATTTTGCCAAATGTC |
| 139 | ACATTTGGCAAAATCAAGG | CCTTGATTTTGCCAAATGT |
| 140 | CATTTGGCAAAATCAAGGC | GCCTTGATTTTGCCAAATG |
| 141 | ATTTGGCAAAATCAAGGCC | GGCCTTGATTTTGCCAAAT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 142 | TTTGGCAAAATCAAGGCCC | GGGCCTTGATTTTGCCAAA |
| 143 | TTGGCAAAATCAAGGCCCT | AGGGCCTTGATTTTGCCAA |
| 144 | TGGCAAAATCAAGGCCCTT | AAGGGCCTTGATTTTGCCA |
| 145 | GGCAAAATCAAGGCCCTTA | TAAGGGCCTTGATTTTGCC |
| 146 | GCAAAATCAAGGCCCTTAG | CTAAGGGCCTTGATTTTGC |
| 147 | CAAAATCAAGGCCCTTAGA | TCTAAGGGCCTTGATTTTG |
| 148 | AAAATCAAGGCCCTTAGAC | GTCTAAGGGCCTTGATTTT |
| 149 | AAATCAAGGCCCTTAGACC | GGTCTAAGGGCCTTGATTT |
| 150 | AATCAAGGCCCTTAGACCA | TGGTCTAAGGGCCTTGATT |
| 151 | ATCAAGGCCCTTAGACCAG | CTGGTCTAAGGGCCTTGAT |
| 152 | TCAAGGCCCTTAGACCAGG | CCTGGTCTAAGGGCCTTGA |
| 153 | CAAGGCCCTTAGACCAGGG | CCCTGGTCTAAGGGCCTTG |
| 154 | AAGGCCCTTAGACCAGGGA | TCCCTGGTCTAAGGGCCTT |
| 155 | AGGCCCTTAGACCAGGGAC | GTCCCTGGTCTAAGGGCCT |
| 156 | GGCCCTTAGACCAGGGACA | TGTCCCTGGTCTAAGGGCC |
| 157 | GCCCTTAGACCAGGGACAG | CTGTCCCTGGTCTAAGGGC |
| 158 | CCCTTAGACCAGGGACAGA | TCTGTCCCTGGTCTAAGGG |
| 159 | CCTTAGACCAGGGACAGAC | GTCTGTCCCTGGTCTAAGG |
| 160 | CTTAGACCAGGGACAGACC | GGTCTGTCCCTGGTCTAAG |
| 161 | TTAGACCAGGGACAGACCC | GGGTCTGTCCCTGGTCTAA |
| 162 | TAGACCAGGGACAGACCCA | TGGGTCTGTCCCTGGTCTA |
| 163 | AGACCAGGGACAGACCCAA | TTGGGTCTGTCCCTGGTCT |
| 164 | GACCAGGGACAGACCCAAG | CTTGGGTCTGTCCCTGGTC |
| 165 | ACCAGGGACAGACCCAAGC | GCTTGGGTCTGTCCCTGGT |
| 166 | CCAGGGACAGACCCAAGCC | GGCTTGGGTCTGTCCCTGG |
| 167 | CAGGGACAGACCCAAGCCC | GGGCTTGGGTCTGTCCCTG |
| 168 | AGGGACAGACCCAAGCCCA | TGGGCTTGGGTCTGTCCCT |
| 169 | GGGACAGACCCAAGCCCAG | CTGGGCTTGGGTCTGTCCC |
| 170 | GGACAGACCCAAGCCCAGG | CCTGGGCTTGGGTCTGTCC |
| 171 | GACAGACCCAAGCCCAGGC | GCCTGGGCTTGGGTCTGTC |
| 172 | ACAGACCCAAGCCCAGGCC | GGCCTGGGCTTGGGTCTGT |
| 173 | CAGACCCAAGCCCAGGCCC | GGGCCTGGGCTTGGGTCTG |
| 174 | AGACCCAAGCCCAGGCCCT | AGGGCCTGGGCTTGGGTCT |
| 175 | GACCCAAGCCCAGGCCCTC | GAGGGCCTGGGCTTGGGTC |
| 176 | ACCCAAGCCCAGGCCCTCC | GGAGGGCCTGGGCTTGGGT |
| 177 | CCCAAGCCCAGGCCCTCCC | GGGAGGGCCTGGGCTTGGG |
| 178 | CCAAGCCCAGGCCCTCCCA | TGGGAGGGCCTGGGCTTGG |
| 179 | CAAGCCCAGGCCCTCCCAG | CTGGGAGGGCCTGGGCTTG |
| 180 | AAGCCCAGGCCCTCCCAGA | TCTGGGAGGGCCTGGGCTT |
| 181 | AGCCCAGGCCCTCCCAGAG | CTCTGGGAGGGCCTGGGCT |
| 182 | GCCCAGGCCCTCCCAGAGG | CCTCTGGGAGGGCCTGGGC |
| 183 | CCCAGGCCCTCCCAGAGGT | ACCTCTGGGAGGGCCTGGG |
| 184 | CCAGGCCCTCCCAGAGGTC | GACCTCTGGGAGGGCCTGG |
| 185 | CAGGCCCTCCCAGAGGTCC | GGACCTCTGGGAGGGCCTG |
| 186 | AGGCCCTCCCAGAGGTCCT | AGGACCTCTGGGAGGGCCT |
| 187 | GGCCCTCCCAGAGGTCCTA | TAGGACCTCTGGGAGGGCC |
| 188 | GCCCTCCCAGAGGTCCTAG | CTAGGACCTCTGGGAGGGC |
| 189 | CCCTCCCAGAGGTCCTAGG | CCTAGGACCTCTGGGAGGG |
| 190 | CCTCCCAGAGGTCCTAGGA | TCCTAGGACCTCTGGGAGG |
| 191 | CTCCCAGAGGTCCTAGGAC | GTCCTAGGACCTCTGGGAG |
| 192 | TCCCAGAGGTCCTAGGACG | CGTCCTAGGACCTCTGGGA |
| 193 | CCCAGAGGTCCTAGGACGC | GCGTCCTAGGACCTCTGGG |
| 194 | CCAGAGGTCCTAGGACGCA | TGCGTCCTAGGACCTCTGG |
| 195 | CAGAGGTCCTAGGACGCAA | TTGCGTCCTAGGACCTCTG |
| 196 | AGAGGTCCTAGGACGCAAC | GTTGCGTCCTAGGACCTCT |
| 197 | GAGGTCCTAGGACGCAACC | GGTTGCGTCCTAGGACCTC |
| 198 | AGGTCCTAGGACGCAACCC | GGGTTGCGTCCTAGGACCT |
| 199 | GGTCCTAGGACGCAACCCT | AGGGTTGCGTCCTAGGACC |
| 200 | GTCCTAGGACGCAACCCTT | AAGGGTTGCGTCCTAGGAC |
| 201 | TCCTAGGACGCAACCCTTT | AAAGGGTTGCGTCCTAGGA |
| 202 | CCTAGGACGCAACCCTTTG | CAAAGGGTTGCGTCCTAGG |
| 203 | CTAGGACGCAACCCTTTGT | ACAAAGGGTTGCGTCCTAG |
| 204 | TAGGACGCAACCCTTTGTG | CACAAAGGGTTGCGTCCTA |
| 205 | AGGACGCAACCCTTTGTGC | GCACAAAGGGTTGCGTCCT |
| 206 | GGACGCAACCCTTTGTGCC | GGCACAAAGGGTTGCGTCC |
| 207 | GACGCAACCCTTTGTGCCC | GGGCACAAAGGGTTGCGTC |
| 208 | ACGCAACCCTTTGTGCCCT | AGGGCACAAAGGGTTGCGT |
| 209 | CGCAACCCTTTGTGCCCTT | AAGGGCACAAAGGGTTGCG |
| 210 | GCAACCCTTTGTGCCCTTG | CAAGGGCACAAAGGGTTGC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 211 | CAACCCTTTGTGCCCTTGG | CCAAGGGCACAAAGGGTTG |
| 212 | AACCCTTTGTGCCCTTGGG | CCCAAGGGCACAAAGGGTT |
| 213 | ACCCTTTGTGCCCTTGGGC | GCCCAAGGGCACAAAGGGT |
| 214 | CCCTTTGTGCCCTTGGGCT | AGCCCAAGGGCACAAAGGG |
| 215 | CCTTTGTGCCCTTGGGCTC | GAGCCCAAGGGCACAAAGG |
| 216 | CTTTGTGCCCTTGGGCTCT | AGAGCCCAAGGGCACAAAG |
| 217 | TTTGTGCCCTTGGGCTCTG | CAGAGCCCAAGGGCACAAA |
| 218 | TTGTGCCCTTGGGCTCTGG | CCAGAGCCCAAGGGCACAA |
| 219 | TGTGCCCTTGGGCTCTGGA | TCCAGAGCCCAAGGGCACA |
| 220 | GTGCCCTTGGGCTCTGGAA | TTCCAGAGCCCAAGGGCAC |
| 221 | TGCCCTTGGGCTCTGGAAG | CTTCCAGAGCCCAAGGGCA |
| 222 | GCCCTTGGGCTCTGGAAGA | TCTTCCAGAGCCCAAGGGC |
| 223 | CCCTTGGGCTCTGGAAGAG | CTCTTCCAGAGCCCAAGGG |
| 224 | CCTTGGGCTCTGGAAGAGG | CCTCTTCCAGAGCCCAAGG |
| 225 | CTTGGGCTCTGGAAGAGGT | ACCTCTTCCAGAGCCCAAG |
| 226 | TTGGGCTCTGGAAGAGGTT | AACCTCTTCCAGAGCCCAA |
| 227 | TGGGCTCTGGAAGAGGTTT | AAACCTCTTCCAGAGCCCA |
| 228 | GGGCTCTGGAAGAGGTTTG | CAAACCTCTTCCAGAGCCC |
| 229 | GGCTCTGGAAGAGGTTTGG | CCAAACCTCTTCCAGAGCC |
| 230 | GCTCTGGAAGAGGTTTGGG | CCCAAACCTCTTCCAGAGC |
| 231 | CTCTGGAAGAGGTTTGGGA | TCCCAAACCTCTTCCAGAG |
| 232 | TCTGGAAGAGGTTTGGGAA | TTCCCAAACCTCTTCCAGA |
| 233 | CTGGAAGAGGTTTGGGAAG | CTTCCCAAACCTCTTCCAG |
| 234 | TGGAAGAGGTTTGGGAAGG | CCTTCCCAAACCTCTTCCA |
| 235 | GGAAGAGGTTTGGGAAGGG | CCCTTCCCAAACCTCTTCC |
| 236 | GAAGAGGTTTGGGAAGGGT | ACCCTTCCCAAACCTCTTC |
| 237 | AAGAGGTTTGGGAAGGGTT | AACCCTTCCCAAACCTCTT |
| 238 | AGAGGTTTGGGAAGGGTTT | AAACCCTTCCCAAACCTCT |
| 239 | GAGGTTTGGGAAGGGTTTG | CAAACCCTTCCCAAACCTC |
| 240 | AGGTTTGGGAAGGGTTTGG | CCAAACCCTTCCCAAACCT |
| 241 | GGTTTGGGAAGGGTTTGGG | CCCAAACCCTTCCCAAACC |
| 242 | GTTTGGGAAGGGTTTGGGG | CCCCAAACCCTTCCCAAAC |
| 243 | TTTGGGAAGGGTTTGGGGT | ACCCCAAACCCTTCCCAAA |
| 244 | TTGGGAAGGGTTTGGGGTG | CACCCCAAACCCTTCCCAA |
| 245 | TGGGAAGGGTTTGGGGTGG | CCACCCCAAACCCTTCCCA |
| 246 | GGGAAGGGTTTGGGGTGGA | TCCACCCCAAACCCTTCCC |
| 247 | GGAAGGGTTTGGGGTGGAA | TTCCACCCCAAACCCTTCC |
| 248 | GAAGGGTTTGGGGTGGAAG | CTTCCACCCCAAACCCTTC |
| 249 | AAGGGTTTGGGGTGGAAGA | TCTTCCACCCCAAACCCTT |
| 250 | AGGGTTTGGGGTGGAAGAT | ATCTTCCACCCCAAACCCT |
| 251 | GGGTTTGGGGTGGAAGATG | CATCTTCCACCCCAAACCC |
| 252 | GGTTTGGGGTGGAAGATGG | CCATCTTCCACCCCAAACC |
| 253 | GTTTGGGGTGGAAGATGGC | GCCATCTTCCACCCCAAAC |
| 254 | TTTGGGGTGGAAGATGGCA | TGCCATCTTCCACCCCAAA |
| 255 | TTGGGGTGGAAGATGGCAA | TTGCCATCTTCCACCCCAA |
| 256 | TGGGGTGGAAGATGGCAAA | TTTGCCATCTTCCACCCCA |
| 257 | GGGGTGGAAGATGGCAAAG | CTTTGCCATCTTCCACCCC |
| 258 | GGGTGGAAGATGGCAAAGA | TCTTTGCCATCTTCCACCC |
| 259 | GGTGGAAGATGGCAAAGAG | CCTCTTTGCCATCTTCCACC |
| 260 | GTGGAAGATGGCAAAGAGC | GCTCTTTGCCATCTTCCAC |
| 261 | TGGAAGATGGCAAAGAGCA | TGCTCTTTGCCATCTTCCA |
| 262 | GGAAGATGGCAAAGAGCAG | CTGCTCTTTGCCATCTTCC |
| 263 | GAAGATGGCAAAGAGCAGC | GCTGCTCTTTGCCATCTTC |
| 264 | AAGATGGCAAAGAGCAGCT | AGCTGCTCTTTGCCATCTT |
| 265 | AGATGGCAAAGAGCAGCTT | AAGCTGCTCTTTGCCATCT |
| 266 | GATGGCAAAGAGCAGCTTG | CAAGCTGCTCTTTGCCATC |
| 267 | ATGGCAAAGAGCAGCTTGG | CCAAGCTGCTCTTTGCCAT |
| 268 | TGGCAAAGAGCAGCTTGGC | GCCAAGCTGCTCTTTGCCA |
| 269 | GGCAAAGAGCAGCTTGGCC | GGCCAAGCTGCTCTTTGCC |
| 270 | GCAAAGAGCAGCTTGGCCA | TGGCCAAGCTGCTCTTTGC |
| 271 | CAAAGAGCAGCTTGGCCAG | CTGGCCAAGCTGCTCTTTG |
| 272 | AAAGAGCAGCTTGGCCAGG | CCTGGCCAAGCTGCTCTTT |
| 273 | AAGAGCAGCTTGGCCAGGT | ACCTGGCCAAGCTGCTCTT |
| 274 | AGAGCAGCTTGGCCAGGTG | CACCTGGCCAAGCTGCTCT |
| 275 | GAGCAGCTTGGCCAGGTGA | TCACCTGGCCAAGCTGCTC |
| 276 | AGCAGCTTGGCCAGGTGAG | CTCACCTGGCCAAGCTGCT |
| 277 | GCAGCTTGGCCAGGTGAGG | CCTCACCTGGCCAAGCTGC |
| 278 | CAGCTTGGCCAGGTGAGGA | TCCTCACCTGGCCAAGCTG |
| 279 | AGCTTGGCCAGGTGAGGAT | ATCCTCACCTGGCCAAGCT |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 280 | GCTTGGCCAGGTGAGGATG | CATCCTCACCTGGCCAAGC |
| 281 | CTTGGCCAGGTGAGGATGA | TCATCCTCACCTGGCCAAG |
| 282 | TTGGCCAGGTGAGGATGAG | CTCATCCTCACCTGGCCAA |
| 283 | TGGCCAGGTGAGGATGAGG | CCTCATCCTCACCTGGCCA |
| 284 | GGCCAGGTGAGGATGAGGC | GCCTCATCCTCACCTGGCC |
| 285 | GCCAGGTGAGGATGAGGCA | TGCCTCATCCTCACCTGGC |
| 286 | CCAGGTGAGGATGAGGCAG | CTGCCTCATCCTCACCTGG |
| 287 | CAGGTGAGGATGAGGCAGG | CCTGCCTCATCCTCACCTG |
| 288 | AGGTGAGGATGAGGCAGGG | CCCTGCCTCATCCTCACCT |
| 289 | GGTGAGGATGAGGCAGGGC | GCCCTGCCTCATCCTCACC |
| 290 | GTGAGGATGAGGCAGGGCA | TGCCCTGCCTCATCCTCAC |
| 291 | TGAGGATGAGGCAGGGCAG | CTGCCCTGCCTCATCCTCA |
| 292 | GAGGATGAGGCAGGGCAGA | TCTGCCCTGCCTCATCCTC |
| 293 | AGGATGAGGCAGGGCAGAC | GTCTGCCCTGCCTCATCCT |
| 294 | GGATGAGGCAGGGCAGACA | TGTCTGCCCTGCCTCATCC |
| 295 | GATGAGGCAGGGCAGACAC | GTGTCTGCCCTGCCTCATC |
| 296 | ATGAGGCAGGGCAGACACA | TGTGTCTGCCCTGCCTCAT |
| 297 | TGAGGCAGGGCAGACACAG | CTGTGTCTGCCCTGCCTCA |
| 298 | GAGGCAGGGCAGACACAGG | CCTGTGTCTGCCCTGCCTC |
| 299 | AGGCAGGGCAGACACAGGC | GCCTGTGTCTGCCCTGCCT |
| 300 | GGCAGGGCAGACACAGGCC | GGCCTGTGTCTGCCCTGCC |
| 301 | GCAGGGCAGACACAGGCCA | TGGCCTGTGTCTGCCCTGC |
| 302 | CAGGGCAGACACAGGCCAG | CTGGCCTGTGTCTGCCCTG |
| 303 | AGGGCAGACACAGGCCAGT | ACTGGCCTGTGTCTGCCCT |
| 304 | GGGCAGACACAGGCCAGTG | CACTGGCCTGTGTCTGCCC |
| 305 | GGCAGACAGAGGCCAGTGG | CCACTGGCCTGTGTCTGCC |
| 306 | GCAGACACAGGCCAGTGGG | CCCACTGGCCTGTGTCTGC |
| 307 | CAGACACAGGCCAGTGGGG | CCCCACTGGCCTGTGTCTG |
| 308 | AGACACAGGCCAGTGGGGC | GCCCCACTGGCCTGTGTCT |
| 309 | GACACAGGCCAGTGGGGCG | CGCCCCACTGGCCTGTGTC |
| 310 | ACACAGGCCAGTGGGGCGT | ACGCCCCACTGGCCTGTGT |
| 311 | CACAGGCCAGTGGGGCGTG | CACGCCCCACTGGCCTGTG |
| 312 | ACAGGCCAGTGGGGCGTGC | GCACGCCCCACTGGCCTGT |
| 313 | CAGGCCAGTGGGGCGTGCC | GGCACGCCCCACTGGCCTG |
| 314 | AGGCCAGTGGGGCGTGCCA | TGGCACGCCCCACTGGCCT |
| 315 | GGCCAGTGGGGCGTGCCAT | ATGGCACGCCCCACTGGCC |
| 316 | GCCAGTGGGGCGTGCCATG | CATGGCACGCCCCACTGGC |
| 317 | CCAGTGGGGCGTGCCATGT | ACATGGCACGCCCCACTGG |
| 318 | CAGTGGGGCGTGCCATGTG | CACATGGCACGCCCCACTG |
| 319 | AGTGGGGCGTGCCATGTGC | GCACATGGCACGCCCCACT |
| 320 | GTGGGGCGTGCCATGTGCC | GGCACATGGCACGCCCCAC |
| 321 | TGGGGCGTGCCATGTGCCA | TGGCACATGGCACGCCCCA |
| 322 | GGGGCGTGCCATGTGCCAC | GTGGCACATGGCACGCCCC |
| 323 | GGGCGTGCCATGTGCCACA | TGTGGCACATGGCACGCCC |
| 324 | GGCGTGCCATGTGCCACAG | CTGTGGCACATGGCACGCC |
| 325 | GCGTGCCATGTGCCACAGA | TCTGTGGCACATGGCACGC |
| 326 | CGTGCCATGTGCCACAGAT | ATCTGTGGCACATGGCACG |
| 327 | GTGCCATGTGCCACAGATG | CATCTGTGGCACATGGCAC |
| 328 | TGCCATGTGCCACAGATGG | CCATCTGTGGCACATGGCA |
| 329 | GCCATGTGCCACAGATGGA | TCCATCTGTGGCACATGGC |
| 330 | CCATGTGCCACAGATGGAG | CTCCATCTGTGGCACATGG |
| 331 | CATGTGCCACAGATGGAGA | TCTCCATCTGTGGCACATG |
| 332 | ATGTGCCACAGATGGAGAG | CTCTCCATCTGTGGCACAT |
| 333 | TGTGCCACAGATGGAGAGG | CCTCTCCATCTGTGGCACA |
| 334 | GTGCCACAGATGGAGAGGA | TCCTCTCCATCTGTGGCAC |
| 335 | TGCCACAGATGGAGAGGAC | GTCCTCTCCATCTGTGGCA |
| 336 | GCCACAGATGGAGAGGACC | GGTCCTCTCCATCTGTGGC |
| 337 | CCACAGATGGAGAGGACCA | TGGTCCTCTCCATCTGTGG |
| 338 | CACAGATGGAGAGGACCAG | CTGGTCCTCTCCATCTGTG |
| 339 | ACAGATGGAGAGGACCAGG | CCTGGTCCTCTCCATCTGT |
| 340 | CAGATGGAGAGGACCAGGA | TCCTGGTCCTCTCCATCTG |
| 341 | AGATGGAGAGGACCAGGAG | CTCCTGGTCCTCTCCATCT |
| 342 | GATGGAGAGGACCAGGAGC | GCTCCTGGTCCTCTCCATC |
| 343 | ATGGAGAGGACCAGGAGCC | GGCTCCTGGTCCTCTCCAT |
| 344 | TGGAGAGGACCAGGAGCCA | TGGCTCCTGGTCCTCTCCA |
| 345 | GGAGAGGACCAGGAGCCAG | CTGGCTCCTGGTCCTCTCC |
| 346 | GAGAGGACCAGGAGCCAGT | ACTGGCTCCTGGTCCTCTC |
| 347 | AGAGGACCAGGAGCCAGTG | CACTGGCTCCTGGTCCTCT |
| 348 | GAGGACCAGGAGCCAGTGG | CCACTGGCTCCTGGTCCTC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 349 | AGGACCAGGAGCCAGTGGC | GCCACTGGCTCCTGGTCCT |
| 350 | GGACCAGGAGCCAGTGGCC | GGCCACTGGCTCCTGGTCC |
| 351 | GACCAGGAGCCAGTGGCCC | GGGCCACTGGCTCCTGGTC |
| 352 | ACCAGGAGCCAGTGGCCCG | CGGGCCACTGGCTCCTGGT |
| 353 | CCAGGAGCCAGTGGCCCGG | CCGGGCCACTGGCTCCTGG |
| 354 | CAGGAGCCAGTGGCCCGGC | GCCGGGCCACTGGCTCCTG |
| 355 | AGGAGCCAGTGGCCCGGCA | TGCCGGGCCACTGGCTCCT |
| 356 | GGAGCCAGTGGCCCGGCAG | CTGCCGGGCCACTGGCTCC |
| 357 | GAGCCAGTGGCCCGGCAGG | CCTGCCGGGCCACTGGCTC |
| 358 | AGCCAGTGGCCCGGCAGGC | GCCTGCCGGGCCACTGGCT |
| 359 | GCCAGTGGCCCGGCAGGCA | TGCCTGCCGGGCCACTGGC |
| 360 | CCAGTGGCCCGGCAGGCAC | GTGCCTGCCGGGCCACTGG |
| 361 | CAGTGGCCCGGCAGGCACA | TGTGCCTGCCGGGCCACTG |
| 362 | AGTGGCCCGGCAGGCACAG | CTGTGCCTGCCGGGCCACT |
| 363 | GTGGCCCGGCAGGCACAGC | GCTGTGCCTGCCGGGCCAC |
| 364 | TGGCCCGGCAGGCACAGCC | GGCTGTGCCTGCCGGGCCA |
| 365 | GGCCCGGCAGGCACAGCCC | GGGCTGTGCCTGCCGGGCC |
| 366 | GCCCGGCAGGCACAGCCCG | CGGGCTGTGCCTGCCGGGC |
| 367 | CCCGGCAGGCACAGCCCGG | CCGGGCTGTGCCTGCCGGG |
| 368 | CCGGCAGGCACAGCCCGGT | ACCGGGCTGTGCCTGCCGG |
| 369 | CGGCAGGCACAGCCCGGTT | AACCGGGCTGTGCCTGCCG |
| 370 | GGCAGGCACAGCCCGGTTG | CAACCGGGCTGTGCCTGCC |
| 371 | GCAGGCACAGCCCGGTTGG | CCAACCGGGCTGTGCCTGC |
| 372 | CAGGCACAGCCCGGTTGGC | GCCAACCGGGCTGTGCCTG |
| 373 | AGGCACAGCCCGGTTGGCG | CGCCAACCGGGCTGTGCCT |
| 374 | GGCACAGCCCGGTTGGCGT | ACGCCAACCGGGCTGTGCC |
| 375 | GCACAGCCCGGTTGGCGTG | CACGCCAACCGGGCTGTGC |
| 376 | CACAGCCCGGTTGGCGTGG | CCACGCCAACCGGGCTGTG |
| 377 | ACAGCCCGGTTGGCGTGGG | CCCACGCCAACCGGGCTGT |
| 378 | CAGCCCGGTTGGCGTGGGC | GCCCACGCCAACCGGGCTG |
| 379 | AGCCCGGTTGGCGTGGGCC | GGCCCACGCCAACCGGGCT |
| 380 | GCCCGGTTGGCGTGGGCCA | TGGCCCACGCCAACCGGGC |
| 381 | CCCGGTTGGCGTGGGCCAG | CTGGCCCACGCCAACCGGG |
| 382 | CCGGTTGGCGTGGGCCAGA | TCTGGCCCACGCCAACCGG |
| 383 | CGGTTGGCGTGGGCCAGAG | CTCTGGCCCACGCCAACCG |
| 384 | GGTTGGCGTGGGCCAGAGC | GCTCTGGCCCACGCCAACC |
| 385 | GTTGGCGTGGGCCAGAGCG | CGCTCTGGCCCACGCCAAC |
| 386 | TTGGCGTGGGCCAGAGCGC | GCGCTCTGGCCCACGCCAA |
| 387 | TGGCGTGGGCCAGAGCGCC | GGCGCTCTGGCCCACGCCA |
| 388 | GGCGTGGGCCAGAGCGCCC | GGGCGCTCTGGCCCACGCC |
| 389 | GCGTGGGCCAGAGCGCCCA | TGGGCGCTCTGGCCCACGC |
| 390 | CGTGGGCCAGAGCGCCCAT | ATGGGCGCTCTGGCCCACG |
| 391 | GTGGGCCAGAGCGCCCATC | GATGGGCGCTCTGGCCCAC |
| 392 | TGGGCCAGAGCGCCCATCA | TGATGGGCGCTCTGGCCCA |
| 393 | GGGCCAGAGCGCCCATCAC | GTGATGGGCGCTCTGGCCC |
| 394 | GGCCAGAGCGCCCATCACT | AGTGATGGGCGCTCTGGCC |
| 395 | GCCAGAGCGCCCATCACTG | CAGTGATGGGCGCTCTGGC |
| 396 | CCAGAGCGCCCATCACTGA | TCAGTGATGGGCGCTCTGG |
| 397 | CAGAGCGCCCATCACTGAC | GTCAGTGATGGGCGCTCTG |
| 398 | AGAGCGCCCATCACTGACC | GGTCAGTGATGGGCGCTCT |
| 399 | GAGCGCCCATCACTGACCC | GGGTCAGTGATGGGCGCTC |
| 400 | AGCGCCCATCACTGACCCG | CGGGTCAGTGATGGGCGCT |
| 401 | GCGCCCATCACTGACCCGT | ACGGGTCAGTGATGGGCGC |
| 402 | CGCCCATCACTGACCCGTG | CACGGGTCAGTGATGGGCG |
| 403 | GCCCATCACTGACCCGTGA | TCACGGGTCAGTGATGGGC |
| 404 | CCCATCACTGACCCGTGAG | CTCACGGGTCAGTGATGGG |
| 405 | CCATCACTGACCCGTGAGA | TCTCACGGGTCAGTGATGG |
| 406 | CATCACTGACCCGTGAGAA | TTCTCACGGGTCAGTGATG |
| 407 | ATCACTGACCCGTGAGAAC | GTTCTCACGGGTCAGTGAT |
| 408 | TCACTGACCCGTGAGAACT | AGTTCTCACGGGTCAGTGA |
| 409 | CACTGACCCGTGAGAACTC | GAGTTCTCACGGGTCAGTG |
| 410 | ACTGACCCGTGAGAACTCG | CGAGTTCTCACGGGTCAGT |
| 411 | CTGACCCGTGAGAACTCGA | TCGAGTTCTCACGGGTCAG |
| 412 | TGACCCGTGAGAACTCGAC | GTCGAGTTCTCACGGGTCA |
| 413 | GACCCGTGAGAACTCGACT | AGTCGAGTTCTCACGGGTC |
| 414 | ACCCGTGAGAACTCGACTG | CAGTCGAGTTCTCACGGGT |
| 415 | CCCGTGAGAACTCGACTGC | GCAGTCGAGTTCTCACGGG |
| 416 | CCGTGAGAACTCGACTGCC | GGCAGTCGAGTTCTCACGG |
| 417 | CGTGAGAACTCGACTGCCC | GGGCAGTCGAGTTCTCACG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 418 | GTGAGAACTCGACTGCCCC | GGGGCAGTCGAGTTCTCAC |
| 419 | TGAGAACTCGACTGCCCCT | AGGGGCAGTCGAGTTCTCA |
| 420 | GAGAACTCGACTGCCCCTG | CAGGGGCAGTCGAGTTCTC |
| 421 | AGAACTCGACTGCCCCTGC | GCAGGGGCAGTCGAGTTCT |
| 422 | GAACTCGACTGCCCCTGCC | GGCAGGGGCAGTCGAGTTC |
| 423 | AACTCGACTGCCCCTGCCA | TGGCAGGGGCAGTCGAGTT |
| 424 | ACTCGACTGCCCCTGCCAG | CTGGCAGGGGCAGTCGAGT |
| 425 | CTCGACTGCCCCTGCCAGC | GCTGGCAGGGGCAGTCGAG |
| 426 | TCGACTGCCCCTGCCAGCT | AGCTGGCAGGGGCAGTCGA |
| 427 | CGACTGCCCCTGCCAGCTC | GAGCTGGCAGGGGCAGTCG |
| 428 | GACTGCCCCTGCCAGCTCT | AGAGCTGGCAGGGGCAGTC |
| 429 | ACTGCCCCTGCCAGCTCTG | CAGAGCTGGCAGGGGCAGT |
| 430 | CTGCCCCTGCCAGCTCTGG | CCAGAGCTGGCAGGGGCAG |
| 431 | TGCCCCTGCCAGCTCTGGC | GCCAGAGCTGGCAGGGGCA |
| 432 | GCCCCTGCCAGCTCTGGCA | TGCCAGAGCTGGCAGGGGC |
| 433 | CCCCTGCCAGCTCTGGCAC | GTGCCAGAGCTGGCAGGGG |
| 434 | CCCTGCCAGCTCTGGCACT | AGTGCCAGAGCTGGCAGGG |
| 435 | CCTGCCAGCTCTGGCACTG | CAGTGCCAGAGCTGGCAGG |
| 436 | CTGCCAGCTCTGGCACTGC | GCAGTGCCAGAGCTGGCAG |
| 437 | TGCCAGCTCTGGCACTGCC | GGCAGTGCCAGAGCTGGCA |
| 438 | GCCAGCTCTGGCACTGCCC | GGGCAGTGCCAGAGCTGGC |
| 439 | CCAGCTCTGGCACTGCCCC | GGGGCAGTGCCAGAGCTGG |
| 440 | CAGCTCTGGCACTGCCCCC | GGGGGCAGTGCCAGAGCTG |
| 441 | AGCTCTGGCACTGCCCCCT | AGGGGGCAGTGCCAGAGCT |
| 442 | GCTCTGGCACTGCCCCCTC | GAGGGGGCAGTGCCAGAGC |
| 443 | CTCTGGCACTGCCCCCTCC | GGAGGGGGCAGTGCCAGAG |
| 444 | TCTGGCACTGCCCCCTCCC | GGGAGGGGGCAGTGCCAGA |
| 445 | CTGGCACTGCCCCCTCCCA | TGGGAGGGGGCAGTGCCAG |
| 446 | TGGCACTGCCCCCTCCCAG | CTGGGAGGGGGCAGTGCCA |
| 447 | GGCACTGCCCCCTCCCAGC | GCTGGGAGGGGGCAGTGCC |
| 448 | GCACTGCCCCCTCCCAGCC | GGCTGGGAGGGGGCAGTGC |
| 449 | CACTGCCCCCTCCCAGCCG | CGGCTGGGAGGGGGCAGTG |
| 450 | ACTGCCCCCTCCCAGCCGC | GCGGCTGGGAGGGGGCAGT |
| 451 | CTGCCCCCTCCCAGCCGCC | GGCGGCTGGGAGGGGGCAG |
| 452 | TGCCCCCTCCCAGCCGCCC | GGGCGGCTGGGAGGGGGCA |
| 453 | GCCCCCTCCCAGCCGCCCC | GGGGCGGCTGGGAGGGGGC |
| 454 | CCCCCTCCCAGCCGCCCCG | CGGGGCGGCTGGGAGGGGG |
| 455 | CCCCTCCCAGCCGCCCCGC | GCGGGGCGGCTGGGAGGGG |
| 456 | CCCTCCCAGCCGCCCCGCC | GGCGGGGCGGCTGGGAGGG |
| 457 | CCTCCCAGCCGCCCCGCCC | GGGCGGGGCGGCTGGGAGG |
| 458 | CTCCCAGCCGCCCCGCCCT | AGGGCGGGGCGGCTGGGAG |
| 459 | TCCCAGCCGCCCCGCCCTA | TAGGGCGGGGCGGCTGGGA |
| 460 | CCCAGCCGCCCCGCCCTAG | CTAGGGCGGGGCGGCTGGG |
| 461 | CCAGCCGCCCCGCCCTAGC | GCTAGGGCGGGGCGGCTGG |
| 462 | CAGCCGCCCCGCCCTAGCA | TGCTAGGGCGGGGCGGCTG |
| 463 | AGCCGCCCCGCCCTAGCAC | GTGCTAGGGCGGGGCGGCT |
| 464 | GCCGCCCCGCCCTAGCACC | GGTGCTAGGGCGGGGCGGC |
| 465 | CCGCCCCGCCCTAGCACCC | GGGTGCTAGGGCGGGGCGG |
| 466 | CGCCCCGCCCTAGCACCCT | AGGGTGCTAGGGCGGGGCG |
| 467 | GCCCCGCCCTAGCACCCTG | CAGGGTGCTAGGGCGGGGC |
| 468 | CCCCGCCCTAGCACCCTGG | CCAGGGTGCTAGGGCGGGG |
| 469 | CCCGCCCTAGCACCCTGGG | CCCAGGGTGCTAGGGCGGG |
| 470 | CCGCCCTAGCACCCTGGGG | CCCCAGGGTGCTAGGGCGG |
| 471 | CGCCCTAGCACCCTGGGGG | CCCCCAGGGTGCTAGGGCG |
| 472 | GCCCTAGCACCCTGGGGGG | CCCCCCAGGGTGCTAGGGC |
| 473 | CCCTAGCACCCTGGGGGGC | GCCCCCCAGGGTGCTAGGG |
| 474 | CCTAGCACCCTGGGGGGCA | TGCCCCCCAGGGTGCTAGG |
| 475 | CTAGCACCCTGGGGGGCAC | GTGCCCCCCAGGGTGCTAG |
| 476 | TAGCACCCTGGGGGGCACC | GGTGCCCCCCAGGGTGCTA |
| 477 | AGCACCCTGGGGGGCACCC | GGGTGCCCCCCAGGGTGCT |
| 478 | GCACCCTGGGGGGCACCCC | GGGGTGCCCCCCAGGGTGC |
| 479 | CACCCTGGGGGGCACCCCG | CGGGGTGCCCCCCAGGGTG |
| 480 | ACCCTGGGGGGCACCCCGC | GCGGGGTGCCCCCCAGGGT |
| 481 | CCCTGGGGGGCACCCCGCC | GGCGGGGTGCCCCCCAGGG |
| 482 | CCTGGGGGGCACCCCGCCC | GGGCGGGGTGCCCCCCAGG |
| 483 | CTGGGGGGCACCCCGCCCA | TGGGCGGGGTGCCCCCCAG |
| 484 | TGGGGGGCACCCCGCCCAA | TTGGGCGGGGTGCCCCCCA |
| 485 | GGGGGGCACCCCGCCCAAC | GTTGGGCGGGGTGCCCCCC |
| 486 | GGGGGCACCCCGCCCAACC | GGTTGGGCGGGGTGCCCCC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 487 | GGGGCACCCCGCCCAACCG | CGGTTGGGCGGGGTGCCCC |
| 488 | GGGCACCCCGCCCAACCGT | ACGGTTGGGCGGGGTGCCC |
| 489 | GGCACCCCGCCCAACCGTG | CACGGTTGGGCGGGGTGCC |
| 490 | GCACCCCGCCCAACCGTGG | CCACGGTTGGGCGGGGTGC |
| 491 | CACCCCGCCCAACCGTGGC | GCCACGGTTGGGCGGGGTG |
| 492 | ACCCCGCCCAACCGTGGCC | GGCCACGGTTGGGCGGGGT |
| 493 | CCCCGCCCAACCGTGGCCT | AGGCCACGGTTGGGCGGGG |
| 494 | CCCGCCCAACCGTGGCCTG | CAGGCCACGGTTGGGCGGG |
| 495 | CCGCCCAACCGTGGCCTGG | CCAGGCCACGGTTGGGCGG |
| 496 | CGCCCAACCGTGGCCTGGT | ACCAGGCCACGGTTGGGCG |
| 497 | GCCCAACCGTGGCCTGGTC | GACCAGGCCACGGTTGGGC |
| 498 | CCCAACCGTGGCCTGGTCC | GGACCAGGCCACGGTTGGG |
| 499 | CCAACCGTGGCCTGGTCCG | CGGACCAGGCCACGGTTGG |
| 500 | CAACCGTGGCCTGGTCCGG | CCGGACCAGGCCACGGTTG |
| 501 | AACCGTGGCCTGGTCCGGC | GCCGGACCAGGCCACGGTT |
| 502 | ACCGTGGCCTGGTCCGGCC | GGCCGGACCAGGCCACGGT |
| 503 | CCGTGGCCTGGTCCGGCCC | GGGCCGGACCAGGCCACGG |
| 504 | CGTGGCCTGGTCCGGCCCC | GGGGCCGGACCAGGCCACG |
| 505 | GTGGCCTGGTCCGGCCCCT | AGGGGCCGGACCAGGCCAC |
| 506 | TGGCCTGGTCCGGCCCCTC | GAGGGGCCGGACCAGGCCA |
| 507 | GGCCTGGTCCGGCCCCTCC | GGAGGGGCCGGACCAGGCC |
| 508 | GCCTGGTCCGGCCCCTCCC | GGGAGGGGCCGGACCAGGC |
| 509 | CCTGGTCCGGCCCCTCCCG | CGGGAGGGGCCGGACCAGG |
| 510 | CTGGTCCGGCCCCTCCCGC | GCGGGAGGGGCCGGACCAG |
| 511 | TGGTCCGGCCCCTCCCGCC | GGCGGGAGGGGCCGGACCA |
| 512 | GGTCCGGCCCCTCCCGCCC | GGGCGGGAGGGGCCGGACC |
| 513 | GTCCGGCCCCTCCCGCCCT | AGGGCGGGAGGGGCCGGAC |
| 514 | TCCGGCCCCTCCCGCCCTT | AAGGGCGGGAGGGGCCGGA |
| 515 | CCGGCCCCTCCCGCCCTTT | AAAGGGCGGGAGGGGCCGG |
| 516 | CGGCCCCTCCCGCCCTTTG | CAAAGGGCGGGAGGGGCCG |
| 517 | GGCCCCTCCCGCCCTTTGC | GCAAAGGGCGGGAGGGGCC |
| 518 | GCCCCTCCCGCCCTTTGCT | AGCAAAGGGCGGGAGGGGC |
| 519 | CCCCTCCCGCCCTTTGCTC | GAGCAAAGGGCGGGAGGGG |
| 520 | CCCTCCCGCCCTTTGCTCC | GGAGCAAAGGGCGGGAGGG |
| 521 | CCTCCCGCCCTTTGCTCCA | TGGAGCAAAGGGCGGGAGG |
| 522 | CTCCCGCCCTTTGCTCCAG | CTGGAGCAAAGGGCGGGAG |
| 523 | TCCCGCCCTTTGCTCCAGT | ACTGGAGCAAAGGGCGGGA |
| 524 | CCCGCCCTTTGCTCCAGTT | AACTGGAGCAAAGGGCGGG |
| 525 | CCGCCCTTTGCTCCAGTTC | GAACTGGAGCAAAGGGCGG |
| 526 | CGCCCTTTGCTCCAGTTCC | GGAACTGGAGCAAAGGGCG |
| 527 | GCCCTTTGCTCCAGTTCCC | GGGAACTGGAGCAAAGGGC |
| 528 | CCCTTTGCTCCAGTTCCCG | CGGGAACTGGAGCAAAGGG |
| 529 | CCTTTGCTCCAGTTCCCGG | CCGGGAACTGGAGCAAAGG |
| 530 | CTTTGCTCCAGTTCCCGGG | CCCGGGAACTGGAGCAAAG |
| 531 | TTTGCTCCAGTTCCCGGGC | GCCCGGGAACTGGAGCAAA |
| 532 | TTGCTCCAGTTCCCGGGCT | AGCCCGGGAACTGGAGCAA |
| 533 | TGCTCCAGTTCCCGGGCTT | AAGCCCGGGAACTGGAGCA |
| 534 | GCTCCAGTTCCCGGGCTTG | CAAGCCCGGGAACTGGAGC |
| 535 | CTCCAGTTCCCGGGCTTGG | CCAAGCCCGGGAACTGGAG |
| 536 | TCCAGTTCCCGGGCTTGGC | GCCAAGCCCGGGAACTGGA |
| 537 | CCAGTTCCCGGGCTTGGCA | TGCCAAGCCCGGGAACTGG |
| 538 | CAGTTCCCGGGCTTGGCAC | GTGCCAAGCCCGGGAACTG |
| 539 | AGTTCCCGGGCTTGGCACC | GGTGCCAAGCCCGGGAACT |
| 540 | GTTCCCGGGCTTGGCACCT | AGGTGCCAAGCCCGGGAAC |
| 541 | TTCCCGGGCTTGGCACCTA | TAGGTGCCAAGCCCGGGAA |
| 542 | TCCCGGGCTTGGCACCTAT | ATAGGTGCCAAGCCCGGGA |
| 543 | CCCGGGCTTGGCACCTATA | TATAGGTGCCAAGCCCGGG |
| 544 | CCGGGCTTGGCACCTATAG | CTATAGGTGCCAAGCCCGG |
| 545 | CGGGCTTGGCACCTATAGT | ACTATAGGTGCCAAGCCCG |
| 546 | GGGCTTGGCACCTATAGTG | CACTATAGGTGCCAAGCCC |
| 547 | GGCTTGGCACCTATAGTGG | CCACTATAGGTGCCAAGCC |
| 548 | GCTTGGCACCTATAGTGGG | CCCACTATAGGTGCCAAGC |
| 549 | CTTGGCACCTATAGTGGGG | CCCCACTATAGGTGCCAAG |
| 550 | TTGGCACCTATAGTGGGGG | CCCCCACTATAGGTGCCAA |
| 551 | TGGCACCTATAGTGGGGGT | ACCCCCACTATAGGTGCCA |
| 552 | GGCACCTATAGTGGGGGTG | CACCCCCACTATAGGTGCC |
| 553 | GCACCTATAGTGGGGGTGC | GCACCCCCACTATAGGTGC |
| 554 | CACCTATAGTGGGGGTGCC | GGCACCCCCACTATAGGTG |
| 555 | ACCTATAGTGGGGGTGCCG | CGGCACCCCCACTATAGGT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 556 | CCTATAGTGGGGGTGCCGC | GCGGCACCCCCACTATAGG |
| 557 | CTATAGTGGGGGTGCCGCC | GGCGGCACCCCCACTATAG |
| 558 | TATAGTGGGGGTGCCGCCC | GGGCGGCACCCCCACTATA |
| 559 | ATAGTGGGGGTGCCGCCCG | CGGGCGGCACCCCCACTAT |
| 560 | TAGTGGGGGTGCCGCCCGC | GCGGGCGGCACCCCCACTA |
| 561 | AGTGGGGGTGCCGCCCGCC | GGCGGGCGGCACCCCCACT |
| 562 | GTGGGGGTGCCGCCCGCCT | AGGCGGGCGGCACCCCCAC |
| 563 | TGGGGGTGCCGCCCGCCTG | CAGGCGGGCGGCACCCCCA |
| 564 | GGGGGTGCCGCCCGCCTGC | GCAGGCGGGCGGCACCCCC |
| 565 | GGGGTGCCGCCCGCCTGCC | GGCAGGCGGGCGGCACCCC |
| 566 | GGGTGCCGCCCGCCTGCCA | TGGCAGGCGGGCGGCACCC |
| 567 | GGTGCCGCCCGCCTGCCAG | CTGGCAGGCGGGCGGCACC |
| 568 | GTGCCGCCCGCCTGCCAGG | CCTGGCAGGCGGGCGGCAC |
| 569 | TGCCGCCCGCCTGCCAGGC | GCCTGGCAGGCGGGCGGCA |
| 570 | GCCGCCCGCCTGCCAGGCT | AGCCTGGCAGGCGGGCGGC |
| 571 | CCGCCCGCCTGCCAGGCTC | GAGCCTGGCAGGCGGGCGG |
| 572 | CGCCCGCCTGCCAGGCTCC | GGAGCCTGGCAGGCGGGCG |
| 573 | GCCCGCCTGCCAGGCTCCG | CGGAGCCTGGCAGGCGGGC |
| 574 | CCCGCCTGCCAGGCTCCGG | CCGGAGCCTGGCAGGCGGG |
| 575 | CCGCCTGCCAGGCTCCGGG | CCCGGAGCCTGGCAGGCGG |
| 576 | CGCCTGCCAGGCTCCGGGG | CCCCGGAGCCTGGCAGGCG |
| 577 | GCCTGCCAGGCTCCGGGGC | GCCCCGGAGCCTGGCAGGC |
| 578 | CCTGCCAGGCTCCGGGGCC | GGCCCCGGAGCCTGGCAGG |
| 579 | CTGCCAGGCTCCGGGGCCG | CGGCCCCGGAGCCTGGCAG |
| 580 | TGCCAGGCTCCGGGGCCGG | CCGGCCCCGGAGCCTGGCA |
| 581 | GCCAGGCTCCGGGGCCGGG | CCCGGCCCCGGAGCCTGGC |
| 582 | CCAGGCTCCGGGGCCGGGC | GCCCGGCCCCGGAGCCTGG |
| 583 | CAGGCTCCGGGGCCGGGCC | GGCCCGGCCCCGGAGCCTG |
| 584 | AGGCTCCGGGGCCGGGCCC | GGGCCCGGCCCCGGAGCCT |
| 585 | GGCTCCGGGGCCGGGCCCA | TGGGCCCGGCCCCGGAGCC |
| 586 | GCTCCGGGGCCGGGCCCAC | GTGGGCCCGGCCCCGGAGC |
| 587 | CTCCGGGGCCGGGCCCACG | CGTGGGCCCGGCCCCGGAG |
| 588 | TCCGGGGCCGGGCCCACGG | CCGTGGGCCCGGCCCCGGA |
| 589 | CCGGGGCCGGGCCCACGGG | CCCGTGGGCCCGGCCCCGG |
| 590 | CGGGGCCGGGCCCACGGGA | TCCCGTGGGCCCGGCCCCG |
| 591 | GGGGCCGGGCCCACGGGAG | CTCCCGTGGGCCCGGCCCC |
| 592 | GGGCCGGGCCCACGGGAGG | CCTCCCGTGGGCCCGGCCC |
| 593 | GGCCGGGCCCACGGGAGGG | CCCTCCCGTGGGCCCGGCC |
| 594 | GCCGGGCCCACGGGAGGGT | ACCCTCCCGTGGGCCCGGC |
| 595 | CCGGGCCCACGGGAGGGTG | CACCCTCCCGTGGGCCCGG |
| 596 | CGGGCCCACGGGAGGGTGG | CCACCCTCCCGTGGGCCCG |
| 597 | GGGCCCACGGGAGGGTGGG | CCCACCCTCCCGTGGGCCC |
| 598 | GGCCCACGGGAGGGTGGGG | CCCCACCCTCCCGTGGGCC |
| 599 | GCCCACGGGAGGGTGGGGC | GCCCCACCCTCCCGTGGGC |
| 600 | CCCACGGGAGGGTGGGGCG | CGCCCCACCCTCCCGTGGG |
| 601 | CCACGGGAGGGTGGGGCGG | CCGCCCCACCCTCCCGTGG |
| 602 | CACGGGAGGGTGGGGCGGC | GCCGCCCCACCCTCCCGTG |
| 603 | ACGGGAGGGTGGGGCGGCT | AGCCGCCCCACCCTCCCGT |
| 604 | CGGGAGGGTGGGGCGGCTG | CAGCCGCCCCACCCTCCCG |
| 605 | GGGAGGGTGGGGCGGCTGG | CCAGCCGCCCCACCCTCCC |
| 606 | GGAGGGTGGGGCGGCTGGG | CCCAGCCGCCCCACCCTCC |
| 607 | GAGGGTGGGGCGGCTGGGA | TCCCAGCCGCCCCACCCTC |
| 608 | AGGGTGGGGCGGCTGGGAA | TTCCCAGCCGCCCCACCCT |
| 609 | GGGTGGGGCGGCTGGGAAG | CTTCCCAGCCGCCCCACCC |
| 610 | GGTGGGGCGGCTGGGAAGC | GCTTCCCAGCCGCCCCACC |
| 611 | GTGGGGCGGCTGGGAAGCT | AGCTTCCCAGCCGCCCCAC |
| 612 | TGGGGCGGCTGGGAAGCTG | CAGCTTCCCAGCCGCCCCA |
| 613 | GGGGCGGCTGGGAAGCTGG | CCAGCTTCCCAGCCGCCCC |
| 614 | GGGCGGCTGGGAAGCTGGC | GCCAGCTTCCCAGCCGCCC |
| 615 | GGCGGCTGGGAAGCTGGCA | TGCCAGCTTCCCAGCCGCC |
| 616 | GCGGCTGGGAAGCTGGCAC | GTGCCAGCTTCCCAGCCGC |
| 617 | CGGCTGGGAAGCTGGCACG | CGTGCCAGCTTCCCAGCCG |
| 618 | GGCTGGGAAGCTGGCACGC | GCGTGCCAGCTTCCCAGCC |
| 619 | GCTGGGAAGCTGGCACGCT | AGCGTGCCAGCTTCCCAGC |
| 620 | CTGGGAAGCTGGCACGCTG | CAGCGTGCCAGCTTCCCAG |
| 621 | TGGGAAGCTGGCACGCTGC | GCAGCGTGCCAGCTTCCCA |
| 622 | GGGAAGCTGGCACGCTGCC | GGCAGCGTGCCAGCTTCCC |
| 623 | GGAAGCTGGCACGCTGCCC | GGGCAGCGTGCCAGCTTCC |
| 624 | GAAGCTGGCACGCTGCCCC | GGGGCAGCGTGCCAGCTTC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 625 | AAGCTGGCACGCTGCCCCG | CGGGGCAGCGTGCCAGCTT |
| 626 | AGCTGGCACGCTGCCCCGG | CCGGGGCAGCGTGCCAGCT |
| 627 | GCTGGCACGCTGCCCCGGG | CCCGGGGCAGCGTGCCAGC |
| 628 | CTGGCACGCTGCCCCGGGG | CCCCGGGGCAGCGTGCCAG |
| 629 | TGGCACGCTGCCCCGGGGG | CCCCCGGGGCAGCGTGCCA |
| 630 | GGCACGCTGCCCCGGGGGA | TCCCCCGGGGCAGCGTGCC |
| 631 | GCACGCTGCCCCGGGGGAG | CTCCCCCGGGGCAGCGTGC |
| 632 | CACGCTGCCCCGGGGGAGC | GCTCCCCCGGGGCAGCGTG |
| 633 | ACGCTGCCCCGGGGGAGCC | GGCTCCCCCGGGGCAGCGT |
| 634 | CGCTGCCCCGGGGGAGCCT | AGGCTCCCCCGGGGCAGCG |
| 635 | GCTGCCCCGGGGGAGCCTC | GAGGCTCCCCCGGGGCAGC |
| 636 | CTGCCCCGGGGGAGCCTCT | AGAGGCTCCCCCGGGGCAG |
| 637 | TGCCCCGGGGGAGCCTCTC | GAGAGGCTCCCCCGGGGCA |
| 638 | GCCCCGGGGGAGCCTCTCT | AGAGAGGCTCCCCCGGGGC |
| 639 | CCCCGGGGGAGCCTCTCTC | GAGAGAGGCTCCCCCGGGG |
| 640 | CCCGGGGGAGCCTCTCTCG | CGAGAGAGGCTCCCCCGGG |
| 641 | CCGGGGGAGCCTCTCTCGG | CCGAGAGAGGCTCCCCCGG |
| 642 | CGGGGGAGCCTCTCTCGGC | GCCGAGAGAGGCTCCCCCG |
| 643 | GGGGGAGCCTCTCTCGGCA | TGCCGAGAGAGGCTCCCCC |
| 644 | GGGGAGCCTCTCTCGGCAG | CTGCCGAGAGAGGCTCCCC |
| 645 | GGGAGCCTCTCTCGGCAGG | CCTGCCGAGAGAGGCTCCC |
| 646 | GGAGCCTCTCTCGGCAGGC | GCCTGCCGAGAGAGGCTCC |
| 647 | GAGCCTCTCTCGGCAGGCG | CGCCTGCCGAGAGAGGCTC |
| 648 | AGCCTCTCTCGGCAGGCGC | GCGCCTGCCGAGAGAGGCT |
| 649 | GCCTCTCTCGGCAGGCGCC | GGCGCCTGCCGAGAGAGGC |
| 650 | CCTCTCTCGGCAGGCGCCC | GGGCGCCTGCCGAGAGAGG |
| 651 | CTCTCTCGGCAGGCGCCCG | CGGGCGCCTGCCGAGAGAG |
| 652 | TCTCTCGGCAGGCGCCCGG | CCGGGCGCCTGCCGAGAGA |
| 653 | CTCTCGGCAGGCGCCCGGG | CCCGGGCGCCTGCCGAGAG |
| 654 | TCTCGGCAGGCGCCCGGGT | ACCCGGGCGCCTGCCGAGA |
| 655 | CTCGGCAGGCGCCCGGGTG | CACCCGGGCGCCTGCCGAG |
| 656 | TCGGCAGGCGCCCGGGTGC | GCACCCGGGCGCCTGCCGA |
| 657 | CGGCAGGCGCCCGGGTGCC | GGCACCCGGGCGCCTGCCG |
| 658 | GGCAGGCGCCCGGGTGCCG | CGGCACCCGGGCGCCTGCC |
| 659 | GCAGGCGCCCGGGTGCCGC | GCGGCACCCGGGCGCCTGC |
| 660 | CAGGCGCCCGGGTGCCGCG | CGCGGCACCCGGGCGCCTG |
| 661 | AGGCGCCCGGGTGCCGCGG | CCGCGGCACCCGGGCGCCT |
| 662 | GGCGCCCGGGTGCCGCGGG | CCCGCGGCACCCGGGCGCC |
| 663 | GCGCCCGGGTGCCGCGGGG | CCCCGCGGCACCCGGGCGC |
| 664 | CGCCCGGGTGCCGCGGGGG | CCCCCGCGGCACCCGGGCG |
| 665 | GCCCGGGTGCCGCGGGGGG | CCCCCCGCGGCACCCGGGC |
| 666 | CCCGGGTGCCGCGGGGGGG | CCCCCCCGCGGCACCCGGG |
| 667 | CCGGGTGCCGCGGGGGGGA | TCCCCCCCGCGGCACCCGG |
| 668 | CGGGTGCCGCGGGGGGGAG | CTCCCCCCCGCGGCACCCG |
| 669 | GGGTGCCGCGGGGGGGAGG | CCTCCCCCCCGCGGCACCC |
| 670 | GGTGCCGCGGGGGGGAGGG | CCCTCCCCCCCGCGGCACC |
| 671 | GTGCCGCGGGGGGGAGGGG | CCCCTCCCCCCCGCGGCAC |
| 672 | TGCCGCGGGGGGGAGGGGG | CCCCCTCCCCCCCGCGGCA |
| 673 | GCCGCGGGGGGGAGGGGGA | TCCCCCTCCCCCCCGCGGC |
| 674 | CCGCGGGGGGGAGGGGGAA | TTCCCCCTCCCCCCCGCGG |
| 675 | CGCGGGGGGGAGGGGGAAC | GTTCCCCCTCCCCCCCGCG |
| 676 | GCGGGGGGGAGGGGGAACA | TGTTCCCCCTCCCCCCCGC |
| 677 | CGGGGGGGAGGGGGAACAA | TTGTTCCCCCTCCCCCCCG |
| 678 | GGGGGGGAGGGGGAACAAA | TTTGTTCCCCCTCCCCCCC |
| 679 | GGGGGGAGGGGGAACAAAG | CTTTGTTCCCCCTCCCCCC |
| 680 | GGGGGAGGGGGAACAAAGG | CCTTTGTTCCCCCTCCCCC |
| 681 | GGGGAGGGGGAACAAAGGG | CCCTTTGTTCCCCCTCCCC |
| 682 | GGGAGGGGGAACAAAGGGC | GCCCTTTGTTCCCCCTCCC |
| 683 | GGAGGGGGAACAAAGGGCT | AGCCCTTTGTTCCCCCTCC |
| 684 | GAGGGGGAACAAAGGGCTC | GAGCCCTTTGTTCCCCCTC |
| 685 | AGGGGGAACAAAGGGCTCA | TGAGCCCTTTGTTCCCCCT |
| 686 | GGGGGAACAAAGGGCTCAT | ATGAGCCCTTTGTTCCCCC |
| 687 | GGGGAACAAAGGGCTCATT | AATGAGCCCTTTGTTCCCC |
| 688 | GGGAACAAAGGGCTCATTC | GAATGAGCCCTTTGTTCCC |
| 689 | GGAACAAAGGGCTCATTCT | AGAATGAGCCCTTTGTTCC |
| 690 | GAACAAAGGGCTCATTCTC | GAGAATGAGCCCTTTGTTC |
| 691 | AACAAAGGGCTCATTCTCC | GGAGAATGAGCCCTTTGTT |
| 692 | ACAAAGGGCTCATTCTCCC | GGGAGAATGAGCCCTTTGT |
| 693 | CAAAGGGCTCATTCTCCCC | GGGGAGAATGAGCCCTTTG |

TABLE 1-continued cDNA Human Hairless 19-mer Target Sequences and Complement Referenced to NM_005144-
*Homo sapiens* hairless homolog (mouse) (HR), transcript variant 1, complete mRNA (1-5699 bp).
(SEQ ID NO: for Sense equals (2X - 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 694 | AAAGGGCTCATTCTCCCCG | CGGGGAGAATGAGCCCTTT |
| 695 | AAGGGCTCATTCTCCCCGT | ACGGGGAGAATGAGCCCTT |
| 696 | AGGGCTCATTCTCCCCGTG | CACGGGGAGAATGAGCCCT |
| 697 | GGGCTCATTCTCCCCGTGC | GCACGGGGAGAATGAGCCC |
| 698 | GGCTCATTCTCCCCGTGCG | CGCACGGGGAGAATGAGCC |
| 699 | GCTCATTCTCCCCGTGCGC | GCGCACGGGGAGAATGAGC |
| 700 | CTCATTCTCCCCGTGCGCA | TGCGCACGGGGAGAATGAG |
| 701 | TCATTCTCCCCGTGCGCAG | CTGCGCACGGGGAGAATGA |
| 702 | CATTCTCCCCGTGCGCAGC | GCTGCGCACGGGGAGAATG |
| 703 | ATTCTCCCCGTGCGCAGCC | GGCTGCGCACGGGGAGAAT |
| 704 | TTCTCCCCGTGCGCAGCCG | CGGCTGCGCACGGGGAGAA |
| 705 | TCTCCCCGTGCGCAGCCGG | CCGGCTGCGCACGGGGAGA |
| 706 | CTCCCCGTGCGCAGCCGGT | ACCGGCTGCGCACGGGGAG |
| 707 | TCCCCGTGCGCAGCCGGTG | CACCGGCTGCGCACGGGGA |
| 708 | CCCCGTGCGCAGCCGGTGG | CCACCGGCTGCGCACGGGG |
| 709 | CCCGTGCGCAGCCGGTGGC | GCCACCGGCTGCGCACGGG |
| 710 | CCGTGCGCAGCCGGTGGCA | TGCCACCGGCTGCGCACGG |
| 711 | CGTGCGCAGCCGGTGGCAT | ATGCCACCGGCTGCGCACG |
| 712 | GTGCGCAGCCGGTGGCATC | GATGCCACCGGCTGCGCAC |
| 713 | TGCGCAGCCGGTGGCATCG | CGATGCCACCGGCTGCGCA |
| 714 | GCGCAGCCGGTGGCATCGC | GCGATGCCACCGGCTGCGC |
| 715 | CGCAGCCGGTGGCATCGCC | GGCGATGCCACCGGCTGCG |
| 716 | GCAGCCGGTGGCATCGCCG | CGGCGATGCCACCGGCTGC |
| 717 | CAGCCGGTGGCATCGCCGG | CCGGCGATGCCACCGGCTG |
| 718 | AGCCGGTGGCATCGCCGGG | CCCGGCGATGCCACCGGCT |
| 719 | GCCGGTGGCATCGCCGGGG | CCCCGGCGATGCCACCGGC |
| 720 | CCGGTGGCATCGCCGGGGC | GCCCCGGCGATGCCACCGG |
| 721 | CGGTGGCATCGCCGGGGCG | CGCCCCGGCGATGCCACCG |
| 722 | GGTGGCATCGCCGGGGCGT | ACGCCCCGGCGATGCCACC |
| 723 | GTGGCATCGCCGGGGCGTT | AACGCCCCGGCGATGCCAC |
| 724 | TGGCATCGCCGGGGCGTTG | CAACGCCCCGGCGATGCCA |
| 725 | GGCATCGCCGGGGCGTTGG | CCAACGCCCCGGCGATGCC |
| 726 | GCATCGCCGGGGCGTTGGC | GCCAACGCCCCGGCGATGC |
| 727 | CATCGCCGGGGCGTTGGCG | CGCCAACGCCCCGGCGATG |
| 728 | ATCGCCGGGGCGTTGGCGG | CCGCCAACGCCCCGGCGAT |
| 729 | TCGCCGGGGCGTTGGCGGA | TCCGCCAACGCCCCGGCGA |
| 730 | CGCCGGGGCGTTGGCGGAA | TTCCGCCAACGCCCCGGCG |
| 731 | GCCGGGGCGTTGGCGGAAG | CTTCCGCCAACGCCCCGGC |
| 732 | CCGGGGCGTTGGCGGAAGC | GCTTCCGCCAACGCCCCGG |
| 733 | CGGGGCGTTGGCGGAAGCC | GGCTTCCGCCAACGCCCCG |
| 734 | GGGGCGTTGGCGGAAGCCC | GGGCTTCCGCCAACGCCCC |
| 735 | GGGCGTTGGCGGAAGCCCC | GGGGCTTCCGCCAACGCCC |
| 736 | GGCGTTGGCGGAAGCCCCC | GGGGGCTTCCGCCAACGCC |
| 737 | GCGTTGGCGGAAGCCCCCG | CGGGGGCTTCCGCCAACGC |
| 738 | CGTTGGCGGAAGCCCCCGG | CCGGGGGCTTCCGCCAACG |
| 739 | GTTGGCGGAAGCCCCCGGG | CCCGGGGGCTTCCGCCAAC |
| 740 | TTGGCGGAAGCCCCCGGGG | CCCCGGGGGCTTCCGCCAA |
| 741 | TGGCGGAAGCCCCCGGGGC | GCCCCGGGGGCTTCCGCCA |
| 742 | GGCGGAAGCCCCCGGGGCC | GGCCCCGGGGGCTTCCGCC |
| 743 | GCGGAAGCCCCCGGGGCCC | GGGCCCCGGGGGCTTCCGC |
| 744 | CGGAAGCCCCCGGGGCCCG | CGGGCCCCGGGGGCTTCCG |
| 745 | GGAAGCCCCCGGGGCCCGG | CCGGGCCCCGGGGGCTTCC |
| 746 | GAAGCCCCCGGGGCCCGGG | CCCGGGCCCCGGGGGCTTC |
| 747 | AAGCCCCCGGGGCCCGGGA | TCCCGGGCCCCGGGGGCTT |
| 748 | AGCCCCCGGGGCCCGGGAG | CTCCCGGGCCCCGGGGGCT |
| 749 | GCCCCCGGGGCCCGGGAGG | CCTCCCGGGCCCCGGGGGC |
| 750 | CCCCCGGGGCCCGGGAGGG | CCCTCCCGGGCCCCGGGGG |
| 751 | CCCCGGGGCCCGGGAGGGG | CCCCTCCCGGGCCCCGGGG |
| 752 | CCCGGGGCCCGGGAGGGGG | CCCCCTCCCGGGCCCCGGG |
| 753 | CCGGGGCCCGGGAGGGGGC | GCCCCCTCCCGGGCCCCGG |
| 754 | CGGGGCCCGGGAGGGGGCA | TGCCCCCTCCCGGGCCCCG |
| 755 | GGGGCCCGGGAGGGGGCAG | CTGCCCCCTCCCGGGCCCC |
| 756 | GGGCCCGGGAGGGGGCAGG | CCTGCCCCCTCCCGGGCCC |
| 757 | GGCCCGGGAGGGGGCAGGC | GCCTGCCCCCTCCCGGGCC |
| 758 | GCCCGGGAGGGGGCAGGCC | GGCCTGCCCCCTCCCGGGC |
| 759 | CCCGGGAGGGGGCAGGCCC | GGGCCTGCCCCCTCCCGGG |
| 760 | CCGGGAGGGGGCAGGCCCA | TGGGCCTGCCCCCTCCCGG |
| 761 | CGGGAGGGGGCAGGCCCAG | CTGGGCCTGCCCCCTCCCG |
| 762 | GGGAGGGGGCAGGCCCAGG | CCTGGGCCTGCCCCCTCCC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 763 | GGAGGGGGCAGGCCCAGGC | GCCTGGGCCTGCCCCCTCC |
| 764 | GAGGGGGCAGGCCCAGGCG | CGCCTGGGCCTGCCCCCTC |
| 765 | AGGGGGCAGGCCCAGGCGC | GCGCCTGGGCCTGCCCCCT |
| 766 | GGGGGCAGGCCCAGGCGCG | CGCGCCTGGGCCTGCCCCC |
| 767 | GGGGCAGGCCCAGGCGCGG | CCGCGCCTGGGCCTGCCCC |
| 768 | GGGCAGGCCCAGGCGCGGC | GCCGCGCCTGGGCCTGCCC |
| 769 | GGCAGGCCCAGGCGCGGCC | GGCCGCGCCTGGGCCTGCC |
| 770 | GCAGGCCCAGGCGCGGCCG | CGGCCGCGCCTGGGCCTGC |
| 771 | CAGGCCCAGGCGCGGCCGC | GCGGCCGCGCCTGGGCCTG |
| 772 | AGGCCCAGGCGCGGCCGCC | GGCGGCCGCGCCTGGGCCT |
| 773 | GGCCCAGGCGCGGCCGCCG | CGGCGGCCGCGCCTGGGCC |
| 774 | GCCCAGGCGCGGCCGCCGA | TCGGCGGCCGCGCCTGGGC |
| 775 | CCCAGGCGCGGCCGCCGAA | TTCGGCGGCCGCGCCTGGG |
| 776 | CCAGGCGCGGCCGCCGAAT | ATTCGGCGGCCGCGCCTGG |
| 777 | CAGGCGCGGCCGCCGAATC | GATTCGGCGGCCGCGCCTG |
| 778 | AGGCGCGGCCGCCGAATCA | TGATTCGGCGGCCGCGCCT |
| 779 | GGCGCGGCCGCCGAATCAC | GTGATTCGGCGGCCGCGCC |
| 780 | GCGCGGCCGCCGAATCACG | CGTGATTCGGCGGCCGCGC |
| 781 | CGCGGCCGCCGAATCACGG | CCGTGATTCGGCGGCCGCG |
| 782 | GCGGCCGCCGAATCACGGG | CCCGTGATTCGGCGGCCGC |
| 783 | CGGCCGCCGAATCACGGGC | GCCCGTGATTCGGCGGCCG |
| 784 | GGCCGCCGAATCACGGGCT | AGCCCGTGATTCGGCGGCC |
| 785 | GCCGCCGAATCACGGGCTC | GAGCCCGTGATTCGGCGG |
| 786 | CCGCCGAATCACGGGCTCC | GGAGCCCGTGATTCGGCGG |
| 787 | CGCCGAATCACGGGCTCCT | AGGAGCCCGTGATTCGGCG |
| 788 | GCCGAATCACGGGCTCCTG | CAGGAGCCCGTGATTCGGC |
| 789 | CCGAATCACGGGCTCCTGT | ACAGGAGCCCGTGATTCGG |
| 790 | CGAATCACGGGCTCCTGTT | AACAGGAGCCCGTGATTCG |
| 791 | GAATCACGGGCTCCTGTTT | AAACAGGAGCCCGTGATTC |
| 792 | AATCACGGGCTCCTGTTTC | GAAACAGGAGCCCGTGATT |
| 793 | ATCACGGGCTCCTGTTTCC | GGAAACAGGAGCCCGTGAT |
| 794 | TCACGGGCTCCTGTTTCCC | GGGAAACAGGAGCCCGTGA |
| 795 | CACGGGCTCCTGTTTCCCG | CGGGAAACAGGAGCCCGTG |
| 796 | ACGGGCTCCTGTTTCCCGC | GCGGGAAACAGGAGCCCGT |
| 797 | CGGGCTCCTGTTTCCCGCA | TGCGGGAAACAGGAGCCCG |
| 798 | GGGCTCCTGTTTCCCGCAG | CTGCGGGAAACAGGAGCCC |
| 799 | GGCTCCTGTTTCCCGCAGG | CCTGCGGGAAACAGGAGCC |
| 800 | GCTCCTGTTTCCCGCAGGG | CCCTGCGGGAAACAGGAGC |
| 801 | CTCCTGTTTCCCGCAGGGT | ACCCTGCGGGAAACAGGAG |
| 802 | TCCTGTTTCCCGCAGGGTG | CACCCTGCGGGAAACAGGA |
| 803 | CCTGTTTCCCGCAGGGTGC | GCACCCTGCGGGAAACAGG |
| 804 | CTGTTTCCCGCAGGGTGCT | AGCACCCTGCGGGAAACAG |
| 805 | TGTTTCCCGCAGGGTGCTG | CAGCACCCTGCGGGAAACA |
| 806 | GTTTCCCGCAGGGTGCTGG | CCAGCACCCTGCGGGAAAC |
| 807 | TTTCCCGCAGGGTGCTGGA | TCCAGCACCCTGCGGGAAA |
| 808 | TTCCCGCAGGGTGCTGGAG | CTCCAGCACCCTGCGGGAA |
| 809 | TCCCGCAGGGTGCTGGAGG | CCTCCAGCACCCTGCGGGA |
| 810 | CCCGCAGGGTGCTGGAGGA | TCCTCCAGCACCCTGCGGG |
| 811 | CCGCAGGGTGCTGGAGGAG | CTCCTCCAGCACCCTGCGG |
| 812 | CGCAGGGTGCTGGAGGAGG | CCTCCTCCAGCACCCTGCG |
| 813 | GCAGGGTGCTGGAGGAGGA | TCCTCCTCCAGCACCCTGC |
| 814 | CAGGGTGCTGGAGGAGGAA | TTCCTCCTCCAGCACCCTG |
| 815 | AGGGTGCTGGAGGAGGAAA | TTTCCTCCTCCAGCACCCT |
| 816 | GGGTGCTGGAGGAGGAAAC | GTTTCCTCCTCCAGCACCC |
| 817 | GGTGCTGGAGGAGGAAACC | GGTTTCCTCCTCCAGCACC |
| 818 | GTGCTGGAGGAGGAAACCG | CGGTTTCCTCCTCCAGCAC |
| 819 | TGCTGGAGGAGGAAACCGG | CCGGTTTCCTCCTCCAGCA |
| 820 | GCTGGAGGAGGAAACCGGC | GCCGGTTTCCTCCTCCAGC |
| 821 | CTGGAGGAGGAAACCGGCG | CGCCGGTTTCCTCCTCCAG |
| 822 | TGGAGGAGGAAACCGGCGG | CCGCCGGTTTCCTCCTCCA |
| 823 | GGAGGAGGAAACCGGCGGA | TCCGCCGGTTTCCTCCTCC |
| 824 | GAGGAGGAAACCGGCGGAG | CTCCGCCGGTTTCCTCCTC |
| 825 | AGGAGGAAACCGGCGGAGC | GCTCCGCCGGTTTCCTCCT |
| 826 | GGAGGAAACCGGCGGAGCA | TGCTCCGCCGGTTTCCTCC |
| 827 | GAGGAAACCGGCGGAGCAG | CTGCTCCGCCGGTTTCCTC |
| 828 | AGGAAACCGGCGGAGCAGC | GCTGCTCCGCCGGTTTCCT |
| 829 | GGAAACCGGCGGAGCAGCT | AGCTGCTCCGCCGGTTTCC |
| 830 | GAAACCGGCGGAGCAGCTT | AAGCTGCTCCGCCGGTTTC |
| 831 | AAACCGGCGGAGCAGCTTC | GAAGCTGCTCCGCCGGTTT |

TABLE 1-continued cDNA Human Hairless 19-mer Target Sequences and Complement Referenced to NM_005144-
*Homo sapiens* hairless homolog (mouse) (HR),
transcript variant 1, complete mRNA (1-5699 bp).
(SEQ ID NO: for Sense equals (2X – 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 832 | AACCGGCGGAGCAGCTTCC | GGAAGCTGCTCCGCCGGTT |
| 833 | ACCGGCGGAGCAGCTTCCC | GGGAAGCTGCTCCGCCGGT |
| 834 | CCGGCGGAGCAGCTTCCCC | GGGGAAGCTGCTCCGCCGG |
| 835 | CGGCGGAGCAGCTTCCCCA | TGGGGAAGCTGCTCCGCCG |
| 836 | GGCGGAGCAGCTTCCCCAC | GTGGGGAAGCTGCTCCGCC |
| 837 | GCGGAGCAGCTTCCCCACT | AGTGGGGAAGCTGCTCCGC |
| 838 | CGGAGCAGCTTCCCCACTC | GAGTGGGGAAGCTGCTCCG |
| 839 | GGAGCAGCTTCCCCACTCT | AGAGTGGGGAAGCTGCTCC |
| 840 | GAGCAGCTTCCCCACTCTC | GAGAGTGGGGAAGCTGCTC |
| 841 | AGCAGCTTCCCCACTCTCA | TGAGAGTGGGGAAGCTGCT |
| 842 | GCAGCTTCCCCACTCTCAG | CTGAGAGTGGGGAAGCTGC |
| 843 | CAGCTTCCCCACTCTCAGT | ACTGAGAGTGGGGAAGCTG |
| 844 | AGCTTCCCCACTCTCAGTT | AACTGAGAGTGGGGAAGCT |
| 845 | GCTTCCCCACTCTCAGTTG | CAACTGAGAGTGGGGAAGC |
| 846 | CTTCCCCACTCTCAGTTGC | GCAACTGAGAGTGGGGAAG |
| 847 | TTCCCCACTCTCAGTTGCG | CGCAACTGAGAGTGGGGAA |
| 848 | TCCCCACTCTCAGTTGCGC | GCGCAACTGAGAGTGGGGA |
| 849 | CCCCACTCTCAGTTGCGCT | AGCGCAACTGAGAGTGGGG |
| 850 | CCCACTCTCAGTTGCGCTT | AAGCGCAACTGAGAGTGGG |
| 851 | CCACTCTCAGTTGCGCTTC | GAAGCGCAACTGAGAGTGG |
| 852 | CACTCTCAGTTGCGCTTCT | AGAAGCGCAACTGAGAGTG |
| 853 | ACTCTCAGTTGCGCTTCTG | CAGAAGCGCAACTGAGAGT |
| 854 | CTCTCAGTTGCGCTTCTGG | CCAGAAGCGCAACTGAGAG |
| 855 | TCTCAGTTGCGCTTCTGGC | GCCAGAAGCGCAACTGAGA |
| 856 | CTCAGTTGCGCTTCTGGCG | CGCCAGAAGCGCAACTGAG |
| 857 | TCAGTTGCGCTTCTGGCGA | TCGCCAGAAGCGCAACTGA |
| 858 | CAGTTGCGCTTCTGGCGAT | ATCGCCAGAAGCGCAACTG |
| 859 | AGTTGCGCTTCTGGCGATG | CATCGCCAGAAGCGCAACT |
| 860 | GTTGCGCTTCTGGCGATGG | CCATCGCCAGAAGCGCAAC |
| 861 | TTGCGCTTCTGGCGATGGC | GCCATCGCCAGAAGCGCAA |
| 862 | TGCGCTTCTGGCGATGGCG | CGCCATCGCCAGAAGCGCA |
| 863 | GCGCTTCTGGCGATGGCGA | TCGCCATCGCCAGAAGCGC |
| 864 | CGCTTCTGGCGATGGCGAT | ATCGCCATCGCCAGAAGCG |
| 865 | GCTTCTGGCGATGGCGATC | GATCGCCATCGCCAGAAGC |
| 866 | CTTCTGGCGATGGCGATCA | TGATCGCCATCGCCAGAAG |
| 867 | TTCTGGCGATGGCGATCAG | CTGATCGCCATCGCCAGAA |
| 868 | TCTGGCGATGGCGATCAGA | TCTGATCGCCATCGCCAGA |
| 869 | CTGGCGATGGCGATCAGAG | CTCTGATCGCCATCGCCAG |
| 870 | TGGCGATGGCGATCAGAGG | CCTCTGATCGCCATCGCCA |
| 871 | GGCGATGGCGATCAGAGGT | ACCTCTGATCGCCATCGCC |
| 872 | GCGATGGCGATCAGAGGTC | GACCTCTGATCGCCATCGC |
| 873 | CGATGGCGATCAGAGGTCC | GGACCTCTGATCGCCATCG |
| 874 | GATGGCGATCAGAGGTCCT | AGGACCTCTGATCGCCATC |
| 875 | ATGGCGATCAGAGGTCCTG | CAGGACCTCTGATCGCCAT |
| 876 | TGGCGATCAGAGGTCCTGC | GCAGGACCTCTGATCGCCA |
| 877 | GGCGATCAGAGGTCCTGCT | AGCAGGACCTCTGATCGCC |
| 878 | GCGATCAGAGGTCCTGCTG | CAGCAGGACCTCTGATCGC |
| 879 | CGATCAGAGGTCCTGCTGC | GCAGCAGGACCTCTGATCG |
| 880 | GATCAGAGGTCCTGCTGCG | CGCAGCAGGACCTCTGATC |
| 881 | ATCAGAGGTCCTGCTGCGC | GCGCAGCAGGACCTCTGAT |
| 882 | TCAGAGGTCCTGCTGCGCT | AGCGCAGCAGGACCTCTGA |
| 883 | CAGAGGTCCTGCTGCGCTC | GAGCGCAGCAGGACCTCTG |
| 884 | AGAGGTCCTGCTGCGCTCT | AGAGCGCAGCAGGACCTCT |
| 885 | GAGGTCCTGCTGCGCTCTC | GAGAGCGCAGCAGGACCTC |
| 886 | AGGTCCTGCTGCGCTCTCC | GGAGAGCGCAGCAGGACCT |
| 887 | GGTCCTGCTGCGCTCTCCG | CGGAGAGCGCAGCAGGACC |
| 888 | GTCCTGCTGCGCTCTCCGC | GCGGAGAGCGCAGCAGGAC |
| 889 | TCCTGCTGCGCTCTCCGCC | GGCGGAGAGCGCAGCAGGA |
| 890 | CCTGCTGCGCTCTCCGCCG | CGGCGGAGAGCGCAGCAGG |
| 891 | CTGCTGCGCTCTCCGCCGC | GCGGCGGAGAGCGCAGCAG |
| 892 | TGCTGCGCTCTCCGCCGCG | CGCGGCGGAGAGCGCAGCA |
| 893 | GCTGCGCTCTCCGCCGCGC | GCGCGGCGGAGAGCGCAGC |
| 894 | CTGCGCTCTCCGCCGCGCT | AGCGCGGCGGAGAGCGCAG |
| 895 | TGCGCTCTCCGCCGCGCTC | GAGCGCGGCGGAGAGCGCA |
| 896 | GCGCTCTCCGCCGCGCTCT | AGAGCGCGGCGGAGAGCGC |
| 897 | CGCTCTCCGCCGCGCTCTA | TAGAGCGCGGCGGAGAGCG |
| 898 | GCTCTCCGCCGCGCTCTAC | GTAGAGCGCGGCGGAGAGC |
| 899 | CTCTCCGCCGCGCTCTACC | GGTAGAGCGCGGCGGAGAG |
| 900 | TCTCCGCCGCGCTCTACCT | AGGTAGAGCGCGGCGGAGA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 901 | CTCCGCCGCGCTCTACCTC | GAGGTAGAGCGCGGCGGAG |
| 902 | TCCGCCGCGCTCTACCTCC | GGAGGTAGAGCGCGGCGGA |
| 903 | CCGCCGCGCTCTACCTCCA | TGGAGGTAGAGCGCGGCGG |
| 904 | CGCCGCGCTCTACCTCCAT | ATGGAGGTAGAGCGCGGCG |
| 905 | GCCGCGCTCTACCTCCATT | AATGGAGGTAGAGCGCGGC |
| 906 | CCGCGCTCTACCTCCATTA | TAATGGAGGTAGAGCGCGG |
| 907 | CGCGCTCTACCTCCATTAG | CTAATGGAGGTAGAGCGCG |
| 908 | GCGCTCTACCTCCATTAGC | GCTAATGGAGGTAGAGCGC |
| 909 | CGCTCTACCTCCATTAGCC | GGCTAATGGAGGTAGAGCG |
| 910 | GCTCTACCTCCATTAGCCG | CGGCTAATGGAGGTAGAGC |
| 911 | CTCTACCTCCATTAGCCGC | GCGGCTAATGGAGGTAGAG |
| 912 | TCTACCTCCATTAGCCGCG | CGCGGCTAATGGAGGTAGA |
| 913 | CTACCTCCATTAGCCGCGC | GCGCGGCTAATGGAGGTAG |
| 914 | TACCTCCATTAGCCGCGCT | AGCGCGGCTAATGGAGGTA |
| 915 | ACCTCCATTAGCCGCGCTG | CAGCGCGGCTAATGGAGGT |
| 916 | CCTCCATTAGCCGCGCTGC | GCAGCGCGGCTAATGGAGG |
| 917 | CTCCATTAGCCGCGCTGCG | CGCAGCGCGGCTAATGGAG |
| 918 | TCCATTAGCCGCGCTGCGC | GCGCAGCGCGGCTAATGGA |
| 919 | CCATTAGCCGCGCTGCGCG | CGCGCAGCGCGGCTAATGG |
| 920 | CATTAGCCGCGCTGCGCGG | CCGCGCAGCGCGGCTAATG |
| 921 | ATTAGCCGCGCTGCGCGGT | ACCGCGCAGCGCGGCTAAT |
| 922 | TTAGCCGCGCTGCGCGGTG | CACCGCGCAGCGCGGCTAA |
| 923 | TAGCCGCGCTGCGCGGTGC | GCACCGCGCAGCGCGGCTA |
| 924 | AGCCGCGCTGCGCGGTGCT | AGCACCGCGCAGCGCGGCT |
| 925 | GCCGCGCTGCGCGGTGCTG | CAGCACCGCGCAGCGCGGC |
| 926 | CCGCGCTGCGCGGTGCTGC | GCAGCACCGCGCAGCGCGG |
| 927 | CGCGCTGCGCGGTGCTGCG | CGCAGCACCGCGCAGCGCG |
| 928 | GCGCTGCGCGGTGCTGCGC | GCGCAGCACCGCGCAGCGC |
| 929 | CGCTGCGCGGTGCTGCGCC | GGCGCAGCACCGCGCAGCG |
| 930 | GCTGCGCGGTGCTGCGCCC | GGGCGCAGCACCGCGCAGC |
| 931 | CTGCGCGGTGCTGCGCCCT | AGGGCGCAGCACCGCGCAG |
| 932 | TGCGCGGTGCTGCGCCCTC | GAGGGCGCAGCACCGCGCA |
| 933 | GCGCGGTGCTGCGCCCTCG | CGAGGGCGCAGCACCGCGC |
| 934 | CGCGGTGCTGCGCCCTCGC | GCGAGGGCGCAGCACCGCG |
| 935 | GCGGTGCTGCGCCCTCGCC | GGCGAGGGCGCAGCACCGC |
| 936 | CGGTGCTGCGCCCTCGCCG | CGGCGAGGGCGCAGCACCG |
| 937 | GGTGCTGCGCCCTCGCCGG | CCGGCGAGGGCGCAGCACC |
| 938 | GTGCTGCGCCCTCGCCGGT | ACCGGCGAGGGCGCAGCAC |
| 939 | TGCTGCGCCCTCGCCGGTG | CACCGGCGAGGGCGCAGCA |
| 940 | GCTGCGCCCTCGCCGGTGC | GCACCGGCGAGGGCGCAGC |
| 941 | CTGCGCCCTCGCCGGTGCC | GGCACCGGCGAGGGCGCAG |
| 942 | TGCGCCCTCGCCGGTGCCT | AGGCACCGGCGAGGGCGCA |
| 943 | GCGCCCTCGCCGGTGCCTC | GAGGCACCGGCGAGGGCGC |
| 944 | CGCCCTCGCCGGTGCCTCT | AGAGGCACCGGCGAGGGCG |
| 945 | GCCCTCGCCGGTGCCTCTC | GAGAGGCACCGGCGAGGGC |
| 946 | CCCTCGCCGGTGCCTCTCT | AGAGAGGCACCGGCGAGGG |
| 947 | CCTCGCCGGTGCCTCTCTC | GAGAGAGGCACCGGCGAGG |
| 948 | CTCGCCGGTGCCTCTCTCC | GGAGAGAGGCACCGGCGAG |
| 949 | TCGCCGGTGCCTCTCTCCT | AGGAGAGAGGCACCGGCGA |
| 950 | CGCCGGTGCCTCTCTCCTG | CAGGAGAGAGGCACCGGCG |
| 951 | GCCGGTGCCTCTCTCCTGG | CCAGGAGAGAGGCACCGGC |
| 952 | CCGGTGCCTCTCTCCTGGG | CCCAGGAGAGAGGCACCGG |
| 953 | CGGTGCCTCTCTCCTGGGT | ACCCAGGAGAGAGGCACCG |
| 954 | GGTGCCTCTCTCCTGGGTC | GACCCAGGAGAGAGGCACC |
| 955 | GTGCCTCTCTCCTGGGTCC | GGACCCAGGAGAGAGGCAC |
| 956 | TGCCTCTCTCCTGGGTCCC | GGGACCCAGGAGAGAGGCA |
| 957 | GCCTCTCTCCTGGGTCCCA | TGGGACCCAGGAGAGAGGC |
| 958 | CCTCTCTCCTGGGTCCCAG | CTGGGACCCAGGAGAGAGG |
| 959 | CTCTCTCCTGGGTCCCAGG | CCTGGGACCCAGGAGAGAG |
| 960 | TCTCTCCTGGGTCCCAGGA | TCCTGGGACCCAGGAGAGA |
| 961 | CTCTCCTGGGTCCCAGGAT | ATCCTGGGACCCAGGAGAG |
| 962 | TCTCCTGGGTCCCAGGATC | GATCCTGGGACCCAGGAGA |
| 963 | CTCCTGGGTCCCAGGATCG | CGATCCTGGGACCCAGGAG |
| 964 | TCCTGGGTCCCAGGATCGG | CCGATCCTGGGACCCAGGA |
| 965 | CCTGGGTCCCAGGATCGGC | GCCGATCCTGGGACCCAGG |
| 966 | CTGGGTCCCAGGATCGGCC | GGCCGATCCTGGGACCCAG |
| 967 | TGGGTCCCAGGATCGGCCC | GGGCCGATCCTGGGACCCA |
| 968 | GGGTCCCAGGATCGGCCCC | GGGGCCGATCCTGGGACCC |
| 969 | GGTCCCAGGATCGGCCCCC | GGGGGCCGATCCTGGGACC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X – 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 970 | GTCCCAGGATCGGCCCCCA | TGGGGGCCGATCCTGGGAC |
| 971 | TCCCAGGATCGGCCCCCAC | GTGGGGGCCGATCCTGGGA |
| 972 | CCCAGGATCGGCCCCCACC | GGTGGGGGCCGATCCTGGG |
| 973 | CCAGGATCGGCCCCCACCA | TGGTGGGGGCCGATCCTGG |
| 974 | CAGGATCGGCCCCCACCAT | ATGGTGGGGGCCGATCCTG |
| 975 | AGGATCGGCCCCCACCATC | GATGGTGGGGGCCGATCCT |
| 976 | GGATCGGCCCCCACCATCC | GGATGGTGGGGGCCGATCC |
| 977 | GATCGGCCCCCACCATCCA | TGGATGGTGGGGGCCGATC |
| 978 | ATCGGCCCCCACCATCCAG | CTGGATGGTGGGGGCCGAT |
| 979 | TCGGCCCCCACCATCCAGG | CCTGGATGGTGGGGGCCGA |
| 980 | CGGCCCCCACCATCCAGGC | GCCTGGATGGTGGGGGCCG |
| 981 | GGCCCCCACCATCCAGGCA | TGCCTGGATGGTGGGGGCC |
| 982 | GCCCCCACCATCCAGGCAC | GTGCCTGGATGGTGGGGGC |
| 983 | CCCCCACCATCCAGGCACG | CGTGCCTGGATGGTGGGGG |
| 984 | CCCCACCATCCAGGCACGA | TCGTGCCTGGATGGTGGGG |
| 985 | CCCACCATCCAGGCACGAC | GTCGTGCCTGGATGGTGGG |
| 986 | CCACCATCCAGGCACGACC | GGTCGTGCCTGGATGGTGG |
| 987 | CACCATCCAGGCACGACCC | GGGTCGTGCCTGGATGGTG |
| 988 | ACCATCCAGGCACGACCCC | GGGGTCGTGCCTGGATGGT |
| 989 | CCATCCAGGCACGACCCCC | GGGGGTCGTGCCTGGATGG |
| 990 | CATCCAGGCACGACCCCCT | AGGGGGTCGTGCCTGGATG |
| 991 | ATCCAGGCACGACCCCCTT | AAGGGGGTCGTGCCTGGAT |
| 992 | TCCAGGCACGACCCCCTTC | GAAGGGGGTCGTGCCTGGA |
| 993 | CCAGGCACGACCCCCTTCC | GGAAGGGGGTCGTGCCTGG |
| 994 | CAGGCACGACCCCCTTCCC | GGGAAGGGGGTCGTGCCTG |
| 995 | AGGCACGACCCCCTTCCCC | GGGGAAGGGGGTCGTGCCT |
| 996 | GGCACGACCCCCTTCCCCG | CGGGGAAGGGGGTCGTGCC |
| 997 | GCACGACCCCCTTCCCCGG | CCGGGGAAGGGGGTCGTGC |
| 998 | CACGACCCCCTTCCCCGGC | GCCGGGGAAGGGGGTCGTG |
| 999 | ACGACCCCCTTCCCCGGCC | GGCCGGGGAAGGGGGTCGT |
| 1000 | CGACCCCCTTCCCCGGCCC | GGGCCGGGGAAGGGGGTCG |
| 1001 | GACCCCCTTCCCCGGCCCC | GGGGCCGGGGAAGGGGGTC |
| 1002 | ACCCCCTTCCCCGGCCCCT | AGGGGCCGGGGAAGGGGGT |
| 1003 | CCCCCTTCCCCGGCCCCTC | GAGGGGCCGGGGAAGGGGG |
| 1004 | CCCCTTCCCCGGCCCCTCG | CGAGGGGCCGGGGAAGGGG |
| 1005 | CCCTTCCCCGGCCCCTCGG | CCGAGGGGCCGGGGAAGGG |
| 1006 | CCTTCCCCGGCCCCTCGGC | GCCGAGGGGCCGGGGAAGG |
| 1007 | CTTCCCCGGCCCCTCGGCC | GGCCGAGGGGCCGGGGAAG |
| 1008 | TTCCCCGGCCCCTCGGCCT | AGGCCGAGGGGCCGGGGAA |
| 1009 | TCCCCGGCCCCTCGGCCTT | AAGGCCGAGGGGCCGGGGA |
| 1010 | CCCCGGCCCCTCGGCCTTT | AAAGGCCGAGGGGCCGGGG |
| 1011 | CCCGGCCCCTCGGCCTTTC | GAAAGGCCGAGGGGCCGGG |
| 1012 | CCGGCCCCTCGGCCTTTCC | GGAAAGGCCGAGGGGCCGG |
| 1013 | CGGCCCCTCGGCCTTTCCC | GGGAAAGGCCGAGGGGCCG |
| 1014 | GGCCCCTCGGCCTTTCCCC | GGGGAAAGGCCGAGGGGCC |
| 1015 | GCCCCTCGGCCTTTCCCCC | GGGGGAAAGGCCGAGGGGC |
| 1016 | CCCCTCGGCCTTTCCCCCA | TGGGGGAAAGGCCGAGGGG |
| 1017 | CCCTCGGCCTTTCCCCCAA | TTGGGGGAAAGGCCGAGGG |
| 1018 | CCTCGGCCTTTCCCCCAAC | GTTGGGGGAAAGGCCGAGG |
| 1019 | CTCGGCCTTTCCCCCAACT | AGTTGGGGGAAAGGCCGAG |
| 1020 | TCGGCCTTTCCCCCAACTC | GAGTTGGGGGAAAGGCCGA |
| 1021 | CGGCCTTTCCCCCAACTCG | CGAGTTGGGGGAAAGGCCG |
| 1022 | GGCCTTTCCCCCAACTCGG | CCGAGTTGGGGGAAAGGCC |
| 1023 | GCCTTTCCCCCAACTCGGC | GCCGAGTTGGGGGAAAGGC |
| 1024 | CCTTTCCCCCAACTCGGCC | GGCCGAGTTGGGGGAAAGG |
| 1025 | CTTTCCCCCAACTCGGCCA | TGGCCGAGTTGGGGGAAAG |
| 1026 | TTTCCCCCAACTCGGCCAT | ATGGCCGAGTTGGGGGAAA |
| 1027 | TTCCCCCAACTCGGCCATC | GATGGCCGAGTTGGGGGAA |
| 1028 | TCCCCCAACTCGGCCATCT | AGATGGCCGAGTTGGGGGA |
| 1029 | CCCCCAACTCGGCCATCTC | GAGATGGCCGAGTTGGGGG |
| 1030 | CCCCAACTCGGCCATCTCC | GGAGATGGCCGAGTTGGGG |
| 1031 | CCCAACTCGGCCATCTCCG | CGGAGATGGCCGAGTTGGG |
| 1032 | CCAACTCGGCCATCTCCGA | TCGGAGATGGCCGAGTTGG |
| 1033 | CAACTCGGCCATCTCCGAC | GTCGGAGATGGCCGAGTTG |
| 1034 | AACTCGGCCATCTCCGACC | GGTCGGAGATGGCCGAGTT |
| 1035 | ACTCGGCCATCTCCGACCC | GGGTCGGAGATGGCCGAGT |
| 1036 | CTCGGCCATCTCCGACCCG | CGGGTCGGAGATGGCCGAG |
| 1037 | TCGGCCATCTCCGACCCGG | CCGGGTCGGAGATGGCCGA |
| 1038 | CGGCCATCTCCGACCCGGG | CCCGGGTCGGAGATGGCCG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 1039 | GGCCATCTCCGACCCGGGG | CCCCGGGTCGGAGATGGCC |
| 1040 | GCCATCTCCGACCCGGGGC | GCCCCGGGTCGGAGATGGC |
| 1041 | CCATCTCCGACCCGGGGCG | CGCCCCGGGTCGGAGATGG |
| 1042 | CATCTCCGACCCGGGGCGC | GCGCCCCGGGTCGGAGATG |
| 1043 | ATCTCCGACCCGGGGCGCG | CGCGCCCCGGGTCGGAGAT |
| 1044 | TCTCCGACCCGGGGCGCGT | ACGCGCCCCGGGTCGGAGA |
| 1045 | CTCCGACCCGGGGCGCGTG | CACGCGCCCCGGGTCGGAG |
| 1046 | TCCGACCCGGGGCGCGTGT | ACACGCGCCCCGGGTCGGA |
| 1047 | CCGACCCGGGGCGCGTGTT | AACACGCGCCCCGGGTCGG |
| 1048 | CGACCCGGGGCGCGTGTTC | GAACACGCGCCCCGGGTCG |
| 1049 | GACCCGGGGCGCGTGTTCC | GGAACACGCGCCCCGGGTC |
| 1050 | ACCCGGGGCGCGTGTTCCC | GGGAACACGCGCCCCGGGT |
| 1051 | CCCGGGGCGCGTGTTCCCC | GGGGAACACGCGCCCCGGG |
| 1052 | CCGGGGCGCGTGTTCCCCC | GGGGGAACACGCGCCCCGG |
| 1053 | CGGGGCGCGTGTTCCCCCC | GGGGGGAACACGCGCCCCG |
| 1054 | GGGGCGCGTGTTCCCCCCG | CGGGGGGAACACGCGCCCC |
| 1055 | GGGCGCGTGTTCCCCCCGG | CCGGGGGGAACACGCGCCC |
| 1056 | GGCGCGTGTTCCCCCCGGC | GCCGGGGGGAACACGCGCC |
| 1057 | GCGCGTGTTCCCCCCGGCC | GGCCGGGGGGAACACGCGC |
| 1058 | CGCGTGTTCCCCCCGGCCC | GGGCCGGGGGGAACACGCG |
| 1059 | GCGTGTTCCCCCCGGCCCG | CGGGCCGGGGGGAACACGC |
| 1060 | CGTGTTCCCCCCGGCCCGG | CCGGGCCGGGGGGAACACG |
| 1061 | GTGTTCCCCCCGGCCCGGC | GCCGGGCCGGGGGGAACAC |
| 1062 | TGTTCCCCCCGGCCCGGCG | CGCCGGGCCGGGGGGAACA |
| 1063 | GTTCCCCCCGGCCCGGCGC | GCGCCGGGCCGGGGGGAAC |
| 1064 | TTCCCCCCGGCCCGGCGCC | GGCGCCGGGCCGGGGGGAA |
| 1065 | TCCCCCCGGCCCGGCGCCT | AGGCGCCGGGCCGGGGGGA |
| 1066 | CCCCCCGGCCCGGCGCCTT | AAGGCGCCGGGCCGGGGGG |
| 1067 | CCCCCGGCCCGGCGCCTTC | GAAGGCGCCGGGCCGGGGG |
| 1068 | CCCCGGCCCGGCGCCTTCT | AGAAGGCGCCGGGCCGGGG |
| 1069 | CCCGGCCCGGCGCCTTCTC | GAGAAGGCGCCGGGCCGGG |
| 1070 | CCGGCCCGGCGCCTTCTCT | AGAGAAGGCGCCGGGCCGG |
| 1071 | CGGCCCGGCGCCTTCTCTC | GAGAGAAGGCGCCGGGCCG |
| 1072 | GGCCCGGCGCCTTCTCTCC | GGAGAGAAGGCGCCGGGCC |
| 1073 | GCCCGGCGCCTTCTCTCCC | GGGAGAGAAGGCGCCGGGC |
| 1074 | CCCGGCGCCTTCTCTCCCT | AGGGAGAGAAGGCGCCGGG |
| 1075 | CCGGCGCCTTCTCTCCCTC | GAGGGAGAGAAGGCGCCGG |
| 1076 | CGGCGCCTTCTCTCCCTCC | GGAGGGAGAGAAGGCGCCG |
| 1077 | GGCGCCTTCTCTCCCTCCG | CGGAGGGAGAGAAGGCGCC |
| 1078 | GCGCCTTCTCTCCCTCCGG | CCGGAGGGAGAGAAGGCGC |
| 1079 | CGCCTTCTCTCCCTCCGGG | CCCGGAGGGAGAGAAGGCG |
| 1080 | GCCTTCTCTCCCTCCGGGG | CCCCGGAGGGAGAGAAGGC |
| 1081 | CCTTCTCTCCCTCCGGGGG | CCCCCGGAGGGAGAGAAGG |
| 1082 | CTTCTCTCCCTCCGGGGGC | GCCCCCGGAGGGAGAGAAG |
| 1083 | TTCTCTCCCTCCGGGGGCA | TGCCCCCGGAGGGAGAGAA |
| 1084 | TCTCTCCCTCCGGGGGCAC | GTGCCCCCGGAGGGAGAGA |
| 1085 | CTCTCCCTCCGGGGGCACC | GGTGCCCCCGGAGGGAGAG |
| 1086 | TCTCCCTCCGGGGGCACCC | GGGTGCCCCCGGAGGGAGA |
| 1087 | CTCCCTCCGGGGGCACCCG | CGGGTGCCCCCGGAGGGAG |
| 1088 | TCCCTCCGGGGGCACCCGC | GCGGGTGCCCCCGGAGGGA |
| 1089 | CCCTCCGGGGGCACCCGCT | AGCGGGTGCCCCCGGAGGG |
| 1090 | CCTCCGGGGGCACCCGCTC | GAGCGGGTGCCCCCGGAGG |
| 1091 | CTCCGGGGGCACCCGCTCC | GGAGCGGGTGCCCCCGGAG |
| 1092 | TCCGGGGGCACCCGCTCCC | GGGAGCGGGTGCCCCCGGA |
| 1093 | CCGGGGGCACCCGCTCCCT | AGGGAGCGGGTGCCCCCGG |
| 1094 | CGGGGGCACCCGCTCCCTA | TAGGGAGCGGGTGCCCCCG |
| 1095 | GGGGGCACCCGCTCCCTAG | CTAGGGAGCGGGTGCCCCC |
| 1096 | GGGGCACCCGCTCCCTAGC | GCTAGGGAGCGGGTGCCCC |
| 1097 | GGGCACCCGCTCCCTAGCC | GGCTAGGGAGCGGGTGCCC |
| 1098 | GGCACCCGCTCCCTAGCCC | GGGCTAGGGAGCGGGTGCC |
| 1099 | GCACCCGCTCCCTAGCCCC | GGGGCTAGGGAGCGGGTGC |
| 1100 | CACCCGCTCCCTAGCCCCG | CGGGGCTAGGGAGCGGGTG |
| 1101 | ACCCGCTCCCTAGCCCCGG | CCGGGGCTAGGGAGCGGGT |
| 1102 | CCCGCTCCCTAGCCCCGGC | GCCGGGGCTAGGGAGCGGG |
| 1103 | CCGCTCCCTAGCCCCGGCC | GGCCGGGGCTAGGGAGCGG |
| 1104 | CGCTCCCTAGCCCCGGCCC | GGGCCGGGGCTAGGGAGCG |
| 1105 | GCTCCCTAGCCCCGGCCCG | CGGGCCGGGGCTAGGGAGC |
| 1106 | CTCCCTAGCCCCGGCCCGG | CCGGGCCGGGGCTAGGGAG |
| 1107 | TCCCTAGCCCCGGCCCGGC | GCCGGGCCGGGGCTAGGGA |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X – 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1108 | CCCTAGCCCCGGCCCGGCC | GGCCGGGCCGGGGCTAGGG |
| 1109 | CCTAGCCCCGGCCCGGCCC | GGGCCGGGCCGGGGCTAGG |
| 1110 | CTAGCCCCGGCCCGGCCCT | AGGGCCGGGCCGGGGCTAG |
| 1111 | TAGCCCCGGCCCGGCCCTC | GAGGGCCGGGCCGGGGCTA |
| 1112 | AGCCCCGGCCCGGCCCTCC | GGAGGGCCGGGCCGGGGCT |
| 1113 | GCCCCGGCCCGGCCCTCCC | GGGAGGGCCGGGCCGGGGC |
| 1114 | CCCCGGCCCGGCCCTCCCC | GGGGAGGGCCGGGCCGGGG |
| 1115 | CCCGGCCCGGCCCTCCCCG | CGGGGAGGGCCGGGCCGGG |
| 1116 | CCGGCCCGGCCCTCCCCGC | GCGGGGAGGGCCGGGCCGG |
| 1117 | CGGCCCGGCCCTCCCCGCG | CGCGGGGAGGGCCGGGCCG |
| 1118 | GGCCCGGCCCTCCCCGCGG | CCGCGGGGAGGGCCGGGCC |
| 1119 | GCCCGGCCCTCCCCGCGGC | GCCGCGGGGAGGGCCGGGC |
| 1120 | CCCGGCCCTCCCCGCGGCG | CGCCGCGGGGAGGGCCGGG |
| 1121 | CCGGCCCTCCCCGCGGCGC | GCGCCGCGGGGAGGGCCGG |
| 1122 | CGGCCCTCCCCGCGGCGCA | TGCGCCGCGGGGAGGGCCG |
| 1123 | GGCCCTCCCCGCGGCGCAG | CTGCGCCGCGGGGAGGGCC |
| 1124 | GCCCTCCCCGCGGCGCAGC | GCTGCGCCGCGGGGAGGGC |
| 1125 | CCCTCCCCGCGGCGCAGCA | TGCTGCGCCGCGGGGAGGG |
| 1126 | CCTCCCCGCGGCGCAGCAC | GTGCTGCGCCGCGGGGAGG |
| 1127 | CTCCCCGCGGCGCAGCACG | CGTGCTGCGCCGCGGGGAG |
| 1128 | TCCCCGCGGCGCAGCACGG | CCGTGCTGCGCCGCGGGGA |
| 1129 | CCCCGCGGCGCAGCACGGA | TCCGTGCTGCGCCGCGGGG |
| 1130 | CCCGCGGCGCAGCACGGAG | CTCCGTGCTGCGCCGCGGG |
| 1131 | CCGCGGCGCAGCACGGAGT | ACTCCGTGCTGCGCCGCGG |
| 1132 | CGCGGCGCAGCACGGAGTC | GACTCCGTGCTGCGCCGCG |
| 1133 | GCGGCGCAGCACGGAGTCT | AGACTCCGTGCTGCGCCGC |
| 1134 | CGGCGCAGCACGGAGTCTC | GAGACTCCGTGCTGCGCCG |
| 1135 | GGCGCAGCACGGAGTCTCG | CGAGACTCCGTGCTGCGCC |
| 1136 | GCGCAGCACGGAGTCTCGG | CCGAGACTCCGTGCTGCGC |
| 1137 | CGCAGCACGGAGTCTCGGC | GCCGAGACTCCGTGCTGCG |
| 1138 | GCAGCACGGAGTCTCGGCG | CGCCGAGACTCCGTGCTGC |
| 1139 | CAGCACGGAGTCTCGGCGT | ACGCCGAGACTCCGTGCTG |
| 1140 | AGCACGGAGTCTCGGCGTC | GACGCCGAGACTCCGTGCT |
| 1141 | GCACGGAGTCTCGGCGTCC | GGACGCCGAGACTCCGTGC |
| 1142 | CACGGAGTCTCGGCGTCCC | GGGACGCCGAGACTCCGTG |
| 1143 | ACGGAGTCTCGGCGTCCCA | TGGGACGCCGAGACTCCGT |
| 1144 | CGGAGTCTCGGCGTCCCAT | ATGGGACGCCGAGACTCCG |
| 1145 | GGAGTCTCGGCGTCCCATG | CATGGGACGCCGAGACTCC |
| 1146 | GAGTCTCGGCGTCCCATGG | CCATGGGACGCCGAGACTC |
| 1147 | AGTCTCGGCGTCCCATGGC | GCCATGGGACGCCGAGACT |
| 1148 | GTCTCGGCGTCCCATGGCG | CGCCATGGGACGCCGAGAC |
| 1149 | TCTCGGCGTCCCATGGCGC | GCGCCATGGGACGCCGAGA |
| 1150 | CTCGGCGTCCCATGGCGCA | TGCGCCATGGGACGCCGAG |
| 1151 | TCGGCGTCCCATGGCGCAA | TTGCGCCATGGGACGCCGA |
| 1152 | CGGCGTCCCATGGCGCAAC | GTTGCGCCATGGGACGCCG |
| 1153 | GGCGTCCCATGGCGCAACC | GGTTGCGCCATGGGACGCC |
| 1154 | GCGTCCCATGGCGCAACCT | AGGTTGCGCCATGGGACGC |
| 1155 | CGTCCCATGGCGCAACCTA | TAGGTTGCGCCATGGGACG |
| 1156 | GTCCCATGGCGCAACCTAC | GTAGGTTGCGCCATGGGAC |
| 1157 | TCCCATGGCGCAACCTACG | CGTAGGTTGCGCCATGGGA |
| 1158 | CCCATGGCGCAACCTACGG | CCGTAGGTTGCGCCATGGG |
| 1159 | CCATGGCGCAACCTACGGC | GCCGTAGGTTGCGCCATGG |
| 1160 | CATGGCGCAACCTACGGCC | GGCCGTAGGTTGCGCCATG |
| 1161 | ATGGCGCAACCTACGGCCT | AGGCCGTAGGTTGCGCCAT |
| 1162 | TGGCGCAACCTACGGCCTC | GAGGCCGTAGGTTGCGCCA |
| 1163 | GGCGCAACCTACGGCCTCG | CGAGGCCGTAGGTTGCGCC |
| 1164 | GCGCAACCTACGGCCTCGG | CCGAGGCCGTAGGTTGCGC |
| 1165 | CGCAACCTACGGCCTCGGC | GCCGAGGCCGTAGGTTGCG |
| 1166 | GCAACCTACGGCCTCGGCC | GGCCGAGGCCGTAGGTTGC |
| 1167 | CAACCTACGGCCTCGGCCC | GGGCCGAGGCCGTAGGTTG |
| 1168 | AACCTACGGCCTCGGCCCA | TGGGCCGAGGCCGTAGGTT |
| 1169 | ACCTACGGCCTCGGCCCAG | CTGGGCCGAGGCCGTAGGT |
| 1170 | CCTACGGCCTCGGCCCAGA | TCTGGGCCGAGGCCGTAGG |
| 1171 | CTACGGCCTCGGCCCAGAA | TTCTGGGCCGAGGCCGTAG |
| 1172 | TACGGCCTCGGCCCAGAAG | CTTCTGGGCCGAGGCCGTA |
| 1173 | ACGGCCTCGGCCCAGAAGC | GCTTCTGGGCCGAGGCCGT |
| 1174 | CGGCCTCGGCCCAGAAGCT | AGCTTCTGGGCCGAGGCCG |
| 1175 | GGCCTCGGCCCAGAAGCTG | CAGCTTCTGGGCCGAGGCC |
| 1176 | GCCTCGGCCCAGAAGCTGG | CCAGCTTCTGGGCCGAGGC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X - 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1177 | CCTCGGCCCAGAAGCTGGT | ACCAGCTTCTGGGCCGAGG |
| 1178 | CTCGGCCCAGAAGCTGGTG | CACCAGCTTCTGGGCCGAG |
| 1179 | TCGGCCCAGAAGCTGGTGC | GCACCAGCTTCTGGGCCGA |
| 1180 | CGGCCCAGAAGCTGGTGCG | CGCACCAGCTTCTGGGCCG |
| 1181 | GGCCCAGAAGCTGGTGCGG | CCGCACCAGCTTCTGGGCC |
| 1182 | GCCCAGAAGCTGGTGCGGC | GCCGCACCAGCTTCTGGGC |
| 1183 | CCCAGAAGCTGGTGCGGCC | GGCCGCACCAGCTTCTGGG |
| 1184 | CCAGAAGCTGGTGCGGCCG | CGGCCGCACCAGCTTCTGG |
| 1185 | CAGAAGCTGGTGCGGCCGA | TCGGCCGCACCAGCTTCTG |
| 1186 | AGAAGCTGGTGCGGCCGAT | ATCGGCCGCACCAGCTTCT |
| 1187 | GAAGCTGGTGCGGCCGATC | GATCGGCCGCACCAGCTTC |
| 1188 | AAGCTGGTGCGGCCGATCC | GGATCGGCCGCACCAGCTT |
| 1189 | AGCTGGTGCGGCCGATCCG | CGGATCGGCCGCACCAGCT |
| 1190 | GCTGGTGCGGCCGATCCGC | GCGGATCGGCCGCACCAGC |
| 1191 | CTGGTGCGGCCGATCCGCG | CGCGGATCGGCCGCACCAG |
| 1192 | TGGTGCGGCCGATCCGCGC | GCGCGGATCGGCCGCACCA |
| 1193 | GGTGCGGCCGATCCGCGCC | GGCGCGGATCGGCCGCACC |
| 1194 | GTGCGGCCGATCCGCGCCG | CGGCGCGGATCGGCCGCAC |
| 1195 | TGCGGCCGATCCGCGCCGT | ACGGCGCGGATCGGCCGCA |
| 1196 | GCGGCCGATCCGCGCCGTG | CACGGCGCGGATCGGCCGC |
| 1197 | CGGCCGATCCGCGCCGTGT | ACACGGCGCGGATCGGCCG |
| 1198 | GGCCGATCCGCGCCGTGTG | CACACGGCGCGGATCGGCC |
| 1199 | GCCGATCCGCGCCGTGTGC | GCACACGGCGCGGATCGGC |
| 1200 | CCGATCCGCGCCGTGTGCC | GGCACACGGCGCGGATCGG |
| 1201 | CGATCCGCGCCGTGTGCCG | CGGCACACGGCGCGGATCG |
| 1202 | GATCCGCGCCGTGTGCCGC | GCGGCACACGGCGCGGATC |
| 1203 | ATCCGCGCCGTGTGCCGCA | TGCGGCACACGGCGCGGAT |
| 1204 | TCCGCGCCGTGTGCCGCAT | ATGCGGCACACGGCGCGGA |
| 1205 | CCGCGCCGTGTGCCGCATC | GATGCGGCACACGGCGCGG |
| 1206 | CGCGCCGTGTGCCGCATCC | GGATGCGGCACACGGCGCG |
| 1207 | GCGCCGTGTGCCGCATCCT | AGGATGCGGCACACGGCGC |
| 1208 | CGCCGTGTGCCGCATCCTG | CAGGATGCGGCACACGGCG |
| 1209 | GCCGTGTGCCGCATCCTGC | GCAGGATGCGGCACACGGC |
| 1210 | CCGTGTGCCGCATCCTGCA | TGCAGGATGCGGCACACGG |
| 1211 | CGTGTGCCGCATCCTGCAG | CTGCAGGATGCGGCACACG |
| 1212 | GTGTGCCGCATCCTGCAGA | TCTGCAGGATGCGGCACAC |
| 1213 | TGTGCCGCATCCTGCAGAT | ATCTGCAGGATGCGGCACA |
| 1214 | GTGCCGCATCCTGCAGATC | GATCTGCAGGATGCGGCAC |
| 1215 | TGCCGCATCCTGCAGATCC | GGATCTGCAGGATGCGGCA |
| 1216 | GCCGCATCCTGCAGATCCC | GGGATCTGCAGGATGCGGC |
| 1217 | CCGCATCCTGCAGATCCCG | CGGGATCTGCAGGATGCGG |
| 1218 | CGCATCCTGCAGATCCCGG | CCGGGATCTGCAGGATGCG |
| 1219 | GCATCCTGCAGATCCCGGA | TCCGGGATCTGCAGGATGC |
| 1220 | CATCCTGCAGATCCCGGAG | CTCCGGGATCTGCAGGATG |
| 1221 | ATCCTGCAGATCCCGGAGT | ACTCCGGGATCTGCAGGAT |
| 1222 | TCCTGCAGATCCCGGAGTC | GACTCCGGGATCTGCAGGA |
| 1223 | CCTGCAGATCCCGGAGTCC | GGACTCCGGGATCTGCAGG |
| 1224 | CTGCAGATCCCGGAGTCCG | CGGACTCCGGGATCTGCAG |
| 1225 | TGCAGATCCCGGAGTCCGA | TCGGACTCCGGGATCTGCA |
| 1226 | GCAGATCCCGGAGTCCGAC | GTCGGACTCCGGGATCTGC |
| 1227 | CAGATCCCGGAGTCCGACC | GGTCGGACTCCGGGATCTG |
| 1228 | AGATCCCGGAGTCCGACCC | GGGTCGGACTCCGGGATCT |
| 1229 | GATCCCGGAGTCCGACCCC | GGGGTCGGACTCCGGGATC |
| 1230 | ATCCCGGAGTCCGACCCCT | AGGGGTCGGACTCCGGGAT |
| 1231 | TCCCGGAGTCCGACCCCTC | GAGGGGTCGGACTCCGGGA |
| 1232 | CCCGGAGTCCGACCCCTCC | GGAGGGGTCGGACTCCGGG |
| 1233 | CCGGAGTCCGACCCCTCCA | TGGAGGGGTCGGACTCCGG |
| 1234 | CGGAGTCCGACCCCTCCAA | TTGGAGGGGTCGGACTCCG |
| 1235 | GGAGTCCGACCCCTCCAAC | GTTGGAGGGGTCGGACTCC |
| 1236 | GAGTCCGACCCCTCCAACC | GGTTGGAGGGGTCGGACTC |
| 1237 | AGTCCGACCCCTCCAACCT | AGGTTGGAGGGGTCGGACT |
| 1238 | GTCCGACCCCTCCAACCTG | CAGGTTGGAGGGGTCGGAC |
| 1239 | TCCGACCCCTCCAACCTGC | GCAGGTTGGAGGGGTCGGA |
| 1240 | CCGACCCCTCCAACCTGCG | CGCAGGTTGGAGGGGTCGG |
| 1241 | CGACCCCTCCAACCTGCGG | CCGCAGGTTGGAGGGGTCG |
| 1242 | GACCCCTCCAACCTGCGGC | GCCGCAGGTTGGAGGGGTC |
| 1243 | ACCCCTCCAACCTGCGGCC | GGCCGCAGGTTGGAGGGGT |
| 1244 | CCCCTCCAACCTGCGGCCC | GGGCCGCAGGTTGGAGGGG |
| 1245 | CCCTCCAACCTGCGGCCCT | AGGGCCGCAGGTTGGAGGG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1246 | CCTCCAACCTGCGGCCCTA | TAGGGCCGCAGGTTGGAGG |
| 1247 | CTCCAACCTGCGGCCCTAG | CTAGGGCCGCAGGTTGGAG |
| 1248 | TCCAACCTGCGGCCCTAGA | TCTAGGGCCGCAGGTTGGA |
| 1249 | CCAACCTGCGGCCCTAGAG | CTCTAGGGCCGCAGGTTGG |
| 1250 | CAACCTGCGGCCCTAGAGC | GCTCTAGGGCCGCAGGTTG |
| 1251 | AACCTGCGGCCCTAGAGCG | CGCTCTAGGGCCGCAGGTT |
| 1252 | ACCTGCGGCCCTAGAGCGC | GCGCTCTAGGGCCGCAGGT |
| 1253 | CCTGCGGCCCTAGAGCGCC | GGCGCTCTAGGGCCGCAGG |
| 1254 | CTGCGGCCCTAGAGCGCCC | GGGCGCTCTAGGGCCGCAG |
| 1255 | TGCGGCCCTAGAGCGCCCC | GGGGCGCTCTAGGGCCGCA |
| 1256 | GCGGCCCTAGAGCGCCCCC | GGGGGCGCTCTAGGGCCGC |
| 1257 | CGGCCCTAGAGCGCCCCCG | CGGGGGCGCTCTAGGGCCG |
| 1258 | GGCCCTAGAGCGCCCCCGC | GCGGGGGCGCTCTAGGGCC |
| 1259 | GCCCTAGAGCGCCCCCGCC | GGCGGGGGCGCTCTAGGGC |
| 1260 | CCCTAGAGCGCCCCCGCCG | CGGCGGGGGCGCTCTAGGG |
| 1261 | CCTAGAGCGCCCCCGCCGC | GCGGCGGGGGCGCTCTAGG |
| 1262 | CTAGAGCGCCCCCGCCGCC | GGCGGCGGGGGCGCTCTAG |
| 1263 | TAGAGCGCCCCCGCCGCCC | GGGCGGCGGGGGCGCTCTA |
| 1264 | AGAGCGCCCCCGCCGCCCC | GGGGCGGCGGGGGCGCTCT |
| 1265 | GAGCGCCCCCGCCGCCCCG | CGGGGCGGCGGGGGCGCTC |
| 1266 | AGCGCCCCCGCCGCCCCGG | CCGGGGCGGCGGGGGCGCT |
| 1267 | GCGCCCCCGCCGCCCCGGG | CCCGGGGCGGCGGGGGCGC |
| 1268 | CGCCCCCGCCGCCCCGGGG | CCCCGGGGCGGCGGGGGCG |
| 1269 | GCCCCCGCCGCCCCGGGGG | CCCCCGGGGCGGCGGGGGC |
| 1270 | CCCCCGCCGCCCCGGGGGA | TCCCCCGGGGCGGCGGGGG |
| 1271 | CCCCGCCGCCCCGGGGGAA | TTCCCCCGGGGCGGCGGGG |
| 1272 | CCCGCCGCCCCGGGGGAAG | CTTCCCCCGGGGCGGCGGG |
| 1273 | CCGCCGCCCCGGGGGAAGG | CCTTCCCCCGGGGCGGCGG |
| 1274 | CGCCGCCCCGGGGGAAGGA | TCCTTCCCCCGGGGCGGCG |
| 1275 | GCCGCCCCGGGGGAAGGAG | CTCCTTCCCCCGGGGCGGC |
| 1276 | CCGCCCCGGGGGAAGGAGA | TCTCCTTCCCCCGGGGCGG |
| 1277 | CGCCCCGGGGGAAGGAGAG | CTCTCCTTCCCCCGGGGCG |
| 1278 | GCCCCGGGGGAAGGAGAGC | GCTCTCCTTCCCCCGGGGC |
| 1279 | CCCCGGGGGAAGGAGAGCG | CGCTCTCCTTCCCCCGGGG |
| 1280 | CCCGGGGGAAGGAGAGCGC | GCGCTCTCCTTCCCCCGGG |
| 1281 | CCGGGGGAAGGAGAGCGCG | CGCGCTCTCCTTCCCCCGG |
| 1282 | CGGGGGAAGGAGAGCGCGA | TCGCGCTCTCCTTCCCCCG |
| 1283 | GGGGGAAGGAGAGCGCGAG | CTCGCGCTCTCCTTCCCCC |
| 1284 | GGGGAAGGAGAGCGCGAGC | GCTCGCGCTCTCCTTCCCC |
| 1285 | GGGAAGGAGAGCGCGAGCG | CGCTCGCGCTCTCCTTCCC |
| 1286 | GGAAGGAGAGCGCGAGCGC | GCGCTCGCGCTCTCCTTCC |
| 1287 | GAAGGAGAGCGCGAGCGCG | CGCGCTCGCGCTCTCCTTC |
| 1288 | AAGGAGAGCGCGAGCGCGC | GCGCGCTCGCGCTCTCCTT |
| 1289 | AGGAGAGCGCGAGCGCGCT | AGCGCGCTCGCGCTCTCCT |
| 1290 | GGAGAGCGCGAGCGCGCTG | CAGCGCGCTCGCGCTCTCC |
| 1291 | GAGAGCGCGAGCGCGCTGA | TCAGCGCGCTCGCGCTCTC |
| 1292 | AGAGCGCGAGCGCGCTGAG | CTCAGCGCGCTCGCGCTCT |
| 1293 | GAGCGCGAGCGCGCTGAGC | GCTCAGCGCGCTCGCGCTC |
| 1294 | AGCGCGAGCGCGCTGAGCA | TGCTCAGCGCGCTCGCGCT |
| 1295 | GCGCGAGCGCGCTGAGCAG | CTGCTCAGCGCGCTCGCGC |
| 1296 | CGCGAGCGCGCTGAGCAGA | TCTGCTCAGCGCGCTCGCG |
| 1297 | GCGAGCGCGCTGAGCAGAC | GTCTGCTCAGCGCGCTCGC |
| 1298 | CGAGCGCGCTGAGCAGACA | TGTCTGCTCAGCGCGCTCG |
| 1299 | GAGCGCGCTGAGCAGACAG | CTGTCTGCTCAGCGCGCTC |
| 1300 | AGCGCGCTGAGCAGACAGA | TCTGTCTGCTCAGCGCGCT |
| 1301 | GCGCGCTGAGCAGACAGAG | CTCTGTCTGCTCAGCGCGC |
| 1302 | CGCGCTGAGCAGACAGAGC | GCTCTGTCTGCTCAGCGCG |
| 1303 | GCGCTGAGCAGACAGAGCG | CGCTCTGTCTGCTCAGCGC |
| 1304 | CGCTGAGCAGACAGAGCGG | CCGCTCTGTCTGCTCAGCG |
| 1305 | GCTGAGCAGACAGAGCGGG | CCCGCTCTGTCTGCTCAGC |
| 1306 | CTGAGCAGACAGAGCGGGA | TCCCGCTCTGTCTGCTCAG |
| 1307 | TGAGCAGACAGAGCGGGAG | CTCCCGCTCTGTCTGCTCA |
| 1308 | GAGCAGACAGAGCGGGAGA | TCTCCCGCTCTGTCTGCTC |
| 1309 | AGCAGACAGAGCGGGAGAA | TTCTCCCGCTCTGTCTGCT |
| 1310 | GCAGACAGAGCGGGAGAAC | GTTCTCCCGCTCTGTCTGC |
| 1311 | CAGACAGAGCGGGAGAACG | CGTTCTCCCGCTCTGTCTG |
| 1312 | AGACAGAGCGGGAGAACGC | GCGTTCTCCCGCTCTGTCT |
| 1313 | GACAGAGCGGGAGAACGCG | CGCGTTCTCCCGCTCTGTC |
| 1314 | ACAGAGCGGGAGAACGCGT | ACGCGTTCTCCCGCTCTGT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 1315 | CAGAGCGGGAGAACGCGTC | GACGCGTTCTCCCGCTCTG |
| 1316 | AGAGCGGGAGAACGCGTCC | GGACGCGTTCTCCCGCTCT |
| 1317 | GAGCGGGAGAACGCGTCCT | AGGACGCGTTCTCCCGCTC |
| 1318 | AGCGGGAGAACGCGTCCTC | GAGGACGCGTTCTCCCGCT |
| 1319 | GCGGGAGAACGCGTCCTCG | CGAGGACGCGTTCTCCCGC |
| 1320 | CGGGAGAACGCGTCCTCGC | GCGAGGACGCGTTCTCCCG |
| 1321 | GGGAGAACGCGTCCTCGCC | GGCGAGGACGCGTTCTCCC |
| 1322 | GGAGAACGCGTCCTCGCCC | GGGCGAGGACGCGTTCTCC |
| 1323 | GAGAACGCGTCCTCGCCCG | CGGGCGAGGACGCGTTCTC |
| 1324 | AGAACGCGTCCTCGCCCGC | GCGGGCGAGGACGCGTTCT |
| 1325 | GAACGCGTCCTCGCCCGCC | GGCGGGCGAGGACGCGTTC |
| 1326 | AACGCGTCCTCGCCCGCCG | CGGCGGGCGAGGACGCGTT |
| 1327 | ACGCGTCCTCGCCCGCCGG | CCGGCGGGCGAGGACGCGT |
| 1328 | CGCGTCCTCGCCCGCCGGC | GCCGGCGGGCGAGGACGCG |
| 1329 | GCGTCCTCGCCCGCCGGCC | GGCCGGCGGGCGAGGACGC |
| 1330 | CGTCCTCGCCCGCCGGCCG | CGGCCGGCGGGCGAGGACG |
| 1331 | GTCCTCGCCCGCCGGCCGG | CCGGCCGGCGGGCGAGGAC |
| 1332 | TCCTCGCCCGCCGGCCGGG | CCCGGCCGGCGGGCGAGGA |
| 1333 | CCTCGCCCGCCGGCCGGGA | TCCCGGCCGGCGGGCGAGG |
| 1334 | CTCGCCCGCCGGCCGGGAG | CTCCCGGCCGGCGGGCGAG |
| 1335 | TCGCCCGCCGGCCGGGAGG | CCTCCCGGCCGGCGGGCGA |
| 1336 | CGCCCGCCGGCCGGGAGGC | GCCTCCCGGCCGGCGGGCG |
| 1337 | GCCCGCCGGCCGGGAGGCC | GGCCTCCCGGCCGGCGGGC |
| 1338 | CCCGCCGGCCGGGAGGCCC | GGGCCTCCCGGCCGGCGGG |
| 1339 | CCGCCGGCCGGGAGGCCCC | GGGGCCTCCCGGCCGGCGG |
| 1340 | CGCCGGCCGGGAGGCCCCG | CGGGGCCTCCCGGCCGGCG |
| 1341 | GCCGGCCGGGAGGCCCCGG | CCGGGGCCTCCCGGCCGGC |
| 1342 | CCGGCCGGGAGGCCCCGGA | TCCGGGGCCTCCCGGCCGG |
| 1343 | CGGCCGGGAGGCCCCGGAG | CTCCGGGGCCTCCCGGCCG |
| 1344 | GGCCGGGAGGCCCCGGAGC | GCTCCGGGGCCTCCCGGCC |
| 1345 | GCCGGGAGGCCCCGGAGCT | AGCTCCGGGGCCTCCCGGC |
| 1346 | CCGGGAGGCCCCGGAGCTG | CAGCTCCGGGGCCTCCCGG |
| 1347 | CGGGAGGCCCCGGAGCTGG | CCAGCTCCGGGGCCTCCCG |
| 1348 | GGGAGGCCCCGGAGCTGGC | GCCAGCTCCGGGGCCTCCC |
| 1349 | GGAGGCCCCGGAGCTGGCC | GGCCAGCTCCGGGGCCTCC |
| 1350 | GAGGCCCCGGAGCTGGCCC | GGGCCAGCTCCGGGGCCTC |
| 1351 | AGGCCCCGGAGCTGGCCCA | TGGGCCAGCTCCGGGGCCT |
| 1352 | GGCCCCGGAGCTGGCCCAT | ATGGGCCAGCTCCGGGGCC |
| 1353 | GCCCCGGAGCTGGCCCATG | CATGGGCCAGCTCCGGGGC |
| 1354 | CCCCGGAGCTGGCCCATGG | CCATGGGCCAGCTCCGGGG |
| 1355 | CCCGGAGCTGGCCCATGGG | CCCATGGGCCAGCTCCGGG |
| 1356 | CCGGAGCTGGCCCATGGGG | CCCCATGGGCCAGCTCCGG |
| 1357 | CGGAGCTGGCCCATGGGGA | TCCCCATGGGCCAGCTCCG |
| 1358 | GGAGCTGGCCCATGGGGAG | CTCCCCATGGGCCAGCTCC |
| 1359 | GAGCTGGCCCATGGGGAGC | GCTCCCCATGGGCCAGCTC |
| 1360 | AGCTGGCCCATGGGGAGCA | TGCTCCCCATGGGCCAGCT |
| 1361 | GCTGGCCCATGGGGAGCAG | CTGCTCCCCATGGGCCAGC |
| 1362 | CTGGCCCATGGGGAGCAGG | CCTGCTCCCCATGGGCCAG |
| 1363 | TGGCCCATGGGGAGCAGGC | GCCTGCTCCCCATGGGCCA |
| 1364 | GGCCCATGGGGAGCAGGCG | CGCCTGCTCCCCATGGGCC |
| 1365 | GCCCATGGGGAGCAGGCGC | GCGCCTGCTCCCCATGGGC |
| 1366 | CCCATGGGGAGCAGGCGCC | GGCGCCTGCTCCCCATGGG |
| 1367 | CCATGGGGAGCAGGCGCCC | GGGCGCCTGCTCCCCATGG |
| 1368 | CATGGGGAGCAGGCGCCCG | CGGGCGCCTGCTCCCCATG |
| 1369 | ATGGGGAGCAGGCGCCCGG | CCGGGCGCCTGCTCCCCAT |
| 1370 | TGGGGAGCAGGCGCCCGGT | ACCGGGCGCCTGCTCCCCA |
| 1371 | GGGGAGCAGGCGCCCGGTG | CACCGGGCGCCTGCTCCCC |
| 1372 | GGGAGCAGGCGCCCGGTGC | GCACCGGGCGCCTGCTCCC |
| 1373 | GGAGCAGGCGCCCGGTGCC | GGCACCGGGCGCCTGCTCC |
| 1374 | GAGCAGGCGCCCGGTGCCG | CGGCACCGGGCGCCTGCTC |
| 1375 | AGCAGGCGCCCGGTGCCGG | CCGGCACCGGGCGCCTGCT |
| 1376 | GCAGGCGCCCGGTGCCGGC | GCCGGCACCGGGCGCCTGC |
| 1377 | CAGGCGCCCGGTGCCGGCC | GGCCGGCACCGGGCGCCTG |
| 1378 | AGGCGCCCGGTGCCGGCCA | TGGCCGGCACCGGGCGCCT |
| 1379 | GGCGCCCGGTGCCGGCCAC | GTGGCCGGCACCGGGCGCC |
| 1380 | GCGCCCGGTGCCGGCCACG | CGTGGCCGGCACCGGGCGC |
| 1381 | CGCCCGGTGCCGGCCACGA | TCGTGGCCGGCACCGGGCG |
| 1382 | GCCCGGTGCCGGCCACGAC | GTCGTGGCCGGCACCGGGC |
| 1383 | CCCGGTGCCGGCCACGACG | CGTCGTGGCCGGCACCGGG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 1384 | CCGGTGCCGGCCACGACGA | TCGTCGTGGCCGGCACCGG |
| 1385 | CGGTGCCGGCCACGACGAC | GTCGTCGTGGCCGGCACCG |
| 1386 | GGTGCCGGCCACGACGACC | GGTCGTCGTGGCCGGCACC |
| 1387 | GTGCCGGCCACGACGACCG | CGGTCGTCGTGGCCGGCAC |
| 1388 | TGCCGGCCACGACGACCGC | GCGGTCGTCGTGGCCGGCA |
| 1389 | GCCGGCCACGACGACCGCC | GGCGGTCGTCGTGGCCGGC |
| 1390 | CCGGCCACGACGACCGCCA | TGGCGGTCGTCGTGGCCGG |
| 1391 | CGGCCACGACGACCGCCAC | GTGGCGGTCGTCGTGGCCG |
| 1392 | GGCCACGACGACCGCCACC | GGTGGCGGTCGTCGTGGCC |
| 1393 | GCCACGACGACCGCCACCG | CGGTGGCGGTCGTCGTGGC |
| 1394 | CCACGACGACCGCCACCGC | GCGGTGGCGGTCGTCGTGG |
| 1395 | CACGACGACCGCCACCGCC | GGCGGTGGCGGTCGTCGTG |
| 1396 | ACGACGACCGCCACCGCCC | GGGCGGTGGCGGTCGTCGT |
| 1397 | CGACGACCGCCACCGCCCG | CGGGCGGTGGCGGTCGTCG |
| 1398 | GACGACCGCCACCGCCCGC | GCGGGCGGTGGCGGTCGTC |
| 1399 | ACGACCGCCACCGCCCGCG | CGCGGGCGGTGGCGGTCGT |
| 1400 | CGACCGCCACCGCCCGCGC | GCGCGGGCGGTGGCGGTCG |
| 1401 | GACCGCCACCGCCCGCGCC | GGCGCGGGCGGTGGCGGTC |
| 1402 | ACCGCCACCGCCCGCGCCG | CGGCGCGGGCGGTGGCGGT |
| 1403 | CCGCCACCGCCCGCGCCGC | GCGGCGCGGGCGGTGGCGG |
| 1404 | CGCCACCGCCCGCGCCGCG | CGCGGCGCGGGCGGTGGCG |
| 1405 | GCCACCGCCCGCGCCGCGA | TCGCGGCGCGGGCGGTGGC |
| 1406 | CCACCGCCCGCGCCGCGAC | GTCGCGGCGCGGGCGGTGG |
| 1407 | CACCGCCCGCGCCGCGACC | GGTCGCGGCGCGGGCGGTG |
| 1408 | ACCGCCCGCGCCGCGACCG | CGGTCGCGGCGCGGGCGGT |
| 1409 | CCGCCCGCGCCGCGACCGG | CCGGTCGCGGCGCGGGCGG |
| 1410 | CGCCCGCGCCGCGACCGGC | GCCGGTCGCGGCGCGGGCG |
| 1411 | GCCCGCGCCGCGACCGGCC | GGCCGGTCGCGGCGCGGGC |
| 1412 | CCCGCGCCGCGACCGGCCG | CGGCCGGTCGCGGCGCGGG |
| 1413 | CCGCGCCGCGACCGGCCGG | CCGGCCGGTCGCGGCGCGG |
| 1414 | CGCGCCGCGACCGGCCGGT | ACCGGCCGGTCGCGGCGCG |
| 1415 | GCGCCGCGACCGGCCGGTG | CACCGGCCGGTCGCGGCGC |
| 1416 | CGCCGCGACCGGCCGGTGA | TCACCGGCCGGTCGCGGCG |
| 1417 | GCCGCGACCGGCCGGTGAA | TTCACCGGCCGGTCGCGGC |
| 1418 | CCGCGACCGGCCGGTGAAG | CTTCACCGGCCGGTCGCGG |
| 1419 | CGCGACCGGCCGGTGAAGC | GCTTCACCGGCCGGTCGCG |
| 1420 | GCGACCGGCCGGTGAAGCC | GGCTTCACCGGCCGGTCGC |
| 1421 | CGACCGGCCGGTGAAGCCC | GGGCTTCACCGGCCGGTCG |
| 1422 | GACCGGCCGGTGAAGCCCA | TGGGCTTCACCGGCCGGTC |
| 1423 | ACCGGCCGGTGAAGCCCAG | CTGGGCTTCACCGGCCGGT |
| 1424 | CCGGCCGGTGAAGCCCAGG | CCTGGGCTTCACCGGCCGG |
| 1425 | CGGCCGGTGAAGCCCAGGG | CCCTGGGCTTCACCGGCCG |
| 1426 | GGCCGGTGAAGCCCAGGGA | TCCCTGGGCTTCACCGGCC |
| 1427 | GCCGGTGAAGCCCAGGGAC | GTCCCTGGGCTTCACCGGC |
| 1428 | CCGGTGAAGCCCAGGGACC | GGTCCCTGGGCTTCACCGG |
| 1429 | CGGTGAAGCCCAGGGACCC | GGGTCCCTGGGCTTCACCG |
| 1430 | GGTGAAGCCCAGGGACCCC | GGGGTCCCTGGGCTTCACC |
| 1431 | GTGAAGCCCAGGGACCCCC | GGGGGTCCCTGGGCTTCAC |
| 1432 | TGAAGCCCAGGGACCCCCC | GGGGGGTCCCTGGGCTTCA |
| 1433 | GAAGCCCAGGGACCCCCCT | AGGGGGGTCCCTGGGCTTC |
| 1434 | AAGCCCAGGGACCCCCCTC | GAGGGGGGTCCCTGGGCTT |
| 1435 | AGCCCAGGGACCCCCCTCT | AGAGGGGGGTCCCTGGGCT |
| 1436 | GCCCAGGGACCCCCCTCTG | CAGAGGGGGGTCCCTGGGC |
| 1437 | CCCAGGGACCCCCCTCTGG | CCAGAGGGGGGTCCCTGGG |
| 1438 | CCAGGGACCCCCCTCTGGG | CCCAGAGGGGGGTCCCTGG |
| 1439 | CAGGGACCCCCCTCTGGGA | TCCCAGAGGGGGGTCCCTG |
| 1440 | AGGGACCCCCCTCTGGGAG | CTCCCAGAGGGGGGTCCCT |
| 1441 | GGGACCCCCCTCTGGGAGA | TCTCCCAGAGGGGGGTCCC |
| 1442 | GGACCCCCCTCTGGGAGAG | CTCTCCCAGAGGGGGGTCC |
| 1443 | GACCCCCCTCTGGGAGAGC | GCTCTCCCAGAGGGGGGTC |
| 1444 | ACCCCCCTCTGGGAGAGCC | GGCTCTCCCAGAGGGGGGT |
| 1445 | CCCCCCTCTGGGAGAGCCC | GGGCTCTCCCAGAGGGGGG |
| 1446 | CCCCCTCTGGGAGAGCCCC | GGGGCTCTCCCAGAGGGGG |
| 1447 | CCCCTCTGGGAGAGCCCCA | TGGGGCTCTCCCAGAGGGG |
| 1448 | CCCTCTGGGAGAGCCCCAT | ATGGGGCTCTCCCAGAGGG |
| 1449 | CCTCTGGGAGAGCCCCATG | CATGGGGCTCTCCCAGAGG |
| 1450 | CTCTGGGAGAGCCCCATGA | TCATGGGGCTCTCCCAGAG |
| 1451 | TCTGGGAGAGCCCCATGAG | CTCATGGGGCTCTCCCAGA |
| 1452 | CTGGGAGAGCCCCATGAGG | CCTCATGGGGCTCTCCCAG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 1453 | TGGGAGAGCCCCATGAGGG | CCCTCATGGGGCTCTCCCA |
| 1454 | GGGAGAGCCCCATGAGGGC | GCCCTCATGGGGCTCTCCC |
| 1455 | GGAGAGCCCCATGAGGGCA | TGCCCTCATGGGGCTCTCC |
| 1456 | GAGAGCCCCATGAGGGCAG | CTGCCCTCATGGGGCTCTC |
| 1457 | AGAGCCCCATGAGGGCAGG | CCTGCCCTCATGGGGCTCT |
| 1458 | GAGCCCCATGAGGGCAGGA | TCCTGCCCTCATGGGGCTC |
| 1459 | AGCCCCATGAGGGCAGGAG | CTCCTGCCCTCATGGGGCT |
| 1460 | GCCCCATGAGGGCAGGAGA | TCTCCTGCCCTCATGGGGC |
| 1461 | CCCCATGAGGGCAGGAGAG | CTCTCCTGCCCTCATGGGG |
| 1462 | CCCATGAGGGCAGGAGAGT | ACTCTCCTGCCCTCATGGG |
| 1463 | CCATGAGGGCAGGAGAGTG | CACTCTCCTGCCCTCATGG |
| 1464 | CATGAGGGCAGGAGAGTGA | TCACTCTCCTGCCCTCATG |
| 1465 | ATGAGGGCAGGAGAGTGAT | ATCACTCTCCTGCCCTCAT |
| 1466 | TGAGGGCAGGAGAGTGATG | CATCACTCTCCTGCCCTCA |
| 1467 | GAGGGCAGGAGAGTGATGG | CCATCACTCTCCTGCCCTC |
| 1468 | AGGGCAGGAGAGTGATGGA | TCCATCACTCTCCTGCCCT |
| 1469 | GGGCAGGAGAGTGATGGAG | CTCCATCACTCTCCTGCCC |
| 1470 | GGCAGGAGAGTGATGGAGA | TCTCCATCACTCTCCTGCC |
| 1471 | GCAGGAGAGTGATGGAGAG | CTCTCCATCACTCTCCTGC |
| 1472 | CAGGAGAGTGATGGAGAGT | ACTCTCCATCACTCTCCTG |
| 1473 | AGGAGAGTGATGGAGAGTA | TACTCTCCATCACTCTCCT |
| 1474 | GGAGAGTGATGGAGAGTAC | GTACTCTCCATCACTCTCC |
| 1475 | GAGAGTGATGGAGAGTACG | CGTACTCTCCATCACTCTC |
| 1476 | AGAGTGATGGAGAGTACGC | GCGTACTCTCCATCACTCT |
| 1477 | GAGTGATGGAGAGTACGCC | GGCGTACTCTCCATCACTC |
| 1478 | AGTGATGGAGAGTACGCCC | GGGCGTACTCTCCATCACT |
| 1479 | GTGATGGAGAGTACGCCCA | TGGGCGTACTCTCCATCAC |
| 1480 | TGATGGAGAGTACGCCCAG | CTGGGCGTACTCTCCATCA |
| 1481 | GATGGAGAGTACGCCCAGC | GCTGGGCGTACTCTCCATC |
| 1482 | ATGGAGAGTACGCCCAGCT | AGCTGGGCGTACTCTCCAT |
| 1483 | TGGAGAGTACGCCCAGCTT | AAGCTGGGCGTACTCTCCA |
| 1484 | GGAGAGTACGCCCAGCTTC | GAAGCTGGGCGTACTCTCC |
| 1485 | GAGAGTACGCCCAGCTTCC | GGAAGCTGGGCGTACTCTC |
| 1486 | AGAGTACGCCCAGCTTCCT | AGGAAGCTGGGCGTACTCT |
| 1487 | GAGTACGCCCAGCTTCCTG | CAGGAAGCTGGGCGTACTC |
| 1488 | AGTACGCCCAGCTTCCTGA | TCAGGAAGCTGGGCGTACT |
| 1489 | GTACGCCCAGCTTCCTGAA | TTCAGGAAGCTGGGCGTAC |
| 1490 | TACGCCCAGCTTCCTGAAG | CTTCAGGAAGCTGGGCGTA |
| 1491 | ACGCCCAGCTTCCTGAAGG | CCTTCAGGAAGCTGGGCGT |
| 1492 | CGCCCAGCTTCCTGAAGGG | CCCTTCAGGAAGCTGGGCG |
| 1493 | GCCCAGCTTCCTGAAGGGC | GCCCTTCAGGAAGCTGGGC |
| 1494 | CCCAGCTTCCTGAAGGGCA | TGCCCTTCAGGAAGCTGGG |
| 1495 | CCAGCTTCCTGAAGGGCAC | GTGCCCTTCAGGAAGCTGG |
| 1496 | CAGCTTCCTGAAGGGCACC | GGTGCCCTTCAGGAAGCTG |
| 1497 | AGCTTCCTGAAGGGCACCC | GGGTGCCCTTCAGGAAGCT |
| 1498 | GCTTCCTGAAGGGCACCCC | GGGGTGCCCTTCAGGAAGC |
| 1499 | CTTCCTGAAGGGCACCCCA | TGGGGTGCCCTTCAGGAAG |
| 1500 | TTCCTGAAGGGCACCCCAA | TTGGGGTGCCCTTCAGGAA |
| 1501 | TCCTGAAGGGCACCCCAAC | GTTGGGGTGCCCTTCAGGA |
| 1502 | CCTGAAGGGCACCCCAACC | GGTTGGGGTGCCCTTCAGG |
| 1503 | CTGAAGGGCACCCCAACCT | AGGTTGGGGTGCCCTTCAG |
| 1504 | TGAAGGGCACCCCAACCTG | CAGGTTGGGGTGCCCTTCA |
| 1505 | GAAGGGCACCCCAACCTGG | CCAGGTTGGGGTGCCCTTC |
| 1506 | AAGGGCACCCCAACCTGGG | CCCAGGTTGGGGTGCCCTT |
| 1507 | AGGGCACCCCAACCTGGGA | TCCCAGGTTGGGGTGCCCT |
| 1508 | GGGCACCCCAACCTGGGAG | CTCCCAGGTTGGGGTGCCC |
| 1509 | GGCACCCCAACCTGGGAGA | TCTCCCAGGTTGGGGTGCC |
| 1510 | GCACCCCAACCTGGGAGAA | TTCTCCCAGGTTGGGGTGC |
| 1511 | CACCCCAACCTGGGAGAAG | CTTCTCCCAGGTTGGGGTG |
| 1512 | ACCCCAACCTGGGAGAAGA | TCTTCTCCCAGGTTGGGGT |
| 1513 | CCCCAACCTGGGAGAAGAC | GTCTTCTCCCAGGTTGGGG |
| 1514 | CCCAACCTGGGAGAAGACG | CGTCTTCTCCCAGGTTGGG |
| 1515 | CCAACCTGGGAGAAGACGG | CCGTCTTCTCCCAGGTTGG |
| 1516 | CAACCTGGGAGAAGACGGC | GCCGTCTTCTCCCAGGTTG |
| 1517 | AACCTGGGAGAAGACGGCC | GGCCGTCTTCTCCCAGGTT |
| 1518 | ACCTGGGAGAAGACGGCCC | GGGCCGTCTTCTCCCAGGT |
| 1519 | CCTGGGAGAAGACGGCCCC | GGGGCCGTCTTCTCCCAGG |
| 1520 | CTGGGAGAAGACGGCCCCA | TGGGGCCGTCTTCTCCCAG |
| 1521 | TGGGAGAAGACGGCCCCAG | CTGGGGCCGTCTTCTCCCA |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1522 | GGGAGAAGACGGCCCCAGA | TCTGGGGCCGTCTTCTCCC |
| 1523 | GGAGAAGACGGCCCCAGAG | CTCTGGGGCCGTCTTCTCC |
| 1524 | GAGAAGACGGGGCCAGAGA | TCTCTGGGGCCGTCTTCTC |
| 1525 | AGAAGACGGCCCCAGAGAA | TTCTCTGGGGCCGTCTTCT |
| 1526 | GAAGACGGCCCCAGAGAAC | GTTCTCTGGGGCCGTCTTC |
| 1527 | AAGACGGCCCCAGAGAACG | CGTTCTCTGGGGCCGTCTT |
| 1528 | AGACGGCCCCAGAGAACGG | CCGTTCTCTGGGGCCGTCT |
| 1529 | GACGGCCCCAGAGAACGGC | GCCGTTCTCTGGGGCCGTC |
| 1530 | ACGGCCCCAGAGAACGGCA | TGCCGTTCTCTGGGGCCGT |
| 1531 | CGGCCCCAGAGAACGGCAT | ATGCCGTTCTCTGGGGCCG |
| 1532 | GGCCCCAGAGAACGGCATC | GATGCCGTTCTCTGGGGCC |
| 1533 | GCCCCAGAGAACGGCATCG | CGATGCCGTTCTCTGGGGC |
| 1534 | CCCCAGAGAACGGCATCGT | ACGATGCCGTTCTCTGGGG |
| 1535 | CCCAGAGAACGGCATCGTG | CACGATGCCGTTCTCTGGG |
| 1536 | CCAGAGAACGGCATCGTGA | TCACGATGCCGTTCTCTGG |
| 1537 | CAGAGAACGGCATCGTGAG | CTCACGATGCCGTTCTCTG |
| 1538 | AGAGAACGGCATCGTGAGA | TCTCACGATGCCGTTCTCT |
| 1539 | GAGAACGGCATCGTGAGAC | GTCTCACGATGCCGTTCTC |
| 1540 | AGAACGGCATCGTGAGACA | TGTCTCACGATGCCGTTCT |
| 1541 | GAACGGCATCGTGAGACAG | CTGTCTCACGATGCCGTTC |
| 1542 | AACGGCATCGTGAGACAGG | CCTGTCTCACGATGCCGTT |
| 1543 | ACGGCATCGTGAGACAGGA | TCCTGTCTCACGATGCCGT |
| 1544 | CGGCATCGTGAGACAGGAG | CTCCTGTCTCACGATGCCG |
| 1545 | GGCATCGTGAGACAGGAGC | GCTCCTGTCTCACGATGCC |
| 1546 | GCATCGTGAGACAGGAGCC | GGCTCCTGTCTCACGATGC |
| 1547 | CATCGTGAGACAGGAGCCC | GGGCTCCTGTCTCACGATG |
| 1548 | ATCGTGAGACAGGAGCCCG | CGGGCTCCTGTCTCACGAT |
| 1549 | TCGTGAGACAGGAGCCCGG | CCGGGCTCCTGTCTCACGA |
| 1550 | CGTGAGACAGGAGCCCGGC | GCCGGGCTCCTGTCTCACG |
| 1551 | GTGAGACAGGAGCCCGGCA | TGCCGGGCTCCTGTCTCAC |
| 1552 | TGAGACAGGAGCCCGGCAG | CTGCCGGGCTCCTGTCTCA |
| 1553 | GAGACAGGAGCCCGGCAGC | GCTGCCGGGCTCCTGTCTC |
| 1554 | AGACAGGAGCCCGGCAGCC | GGCTGCCGGGCTCCTGTCT |
| 1555 | GACAGGAGCCCGGCAGCCC | GGGCTGCCGGGCTCCTGTC |
| 1556 | ACAGGAGCCCGGCAGCCCG | CGGGCTGCCGGGCTCCTGT |
| 1557 | CAGGAGCCCGGCAGCCCGC | GCGGGCTGCCGGGCTCCTG |
| 1558 | AGGAGCCCGGCAGCCCGCC | GGCGGGCTGCCGGGCTCCT |
| 1559 | GGAGCCCGGCAGCCCGCCT | AGGCGGGCTGCCGGGCTCC |
| 1560 | GAGCCCGGCAGCCCGCCTC | GAGGCGGGCTGCCGGGCTC |
| 1561 | AGCCCGGCAGCCCGCCTCG | CGAGGCGGGCTGCCGGGCT |
| 1562 | GCCCGGCAGCCCGCCTCGA | TCGAGGCGGGCTGCCGGGC |
| 1563 | CCCGGCAGCCCGCCTCGAG | CTCGAGGCGGGCTGCCGGG |
| 1564 | CCGGCAGCCCGCCTCGAGA | TCTCGAGGCGGGCTGCCGG |
| 1565 | CGGCAGCCCGCCTCGAGAT | ATCTCGAGGCGGGCTGCCG |
| 1566 | GGCAGCCCGCCTCGAGATG | CATCTCGAGGCGGGCTGCC |
| 1567 | GCAGCCCGCCTCGAGATGG | CCATCTCGAGGCGGGCTGC |
| 1568 | CAGCCCGCCTCGAGATGGA | TCCATCTCGAGGCGGGCTG |
| 1569 | AGCCCGCCTCGAGATGGAC | GTCCATCTCGAGGCGGGCT |
| 1570 | GCCCGCCTCGAGATGGACT | AGTCCATCTCGAGGCGGGC |
| 1571 | CCCGCCTCGAGATGGACTG | CAGTCCATCTCGAGGCGGG |
| 1572 | CCGCCTCGAGATGGACTGC | GCAGTCCATCTCGAGGCGG |
| 1573 | CGCCTCGAGATGGACTGCA | TGCAGTCCATCTCGAGGCG |
| 1574 | GCCTCGAGATGGACTGCAC | GTGCAGTCCATCTCGAGGC |
| 1575 | CCTCGAGATGGACTGCACC | GGTGCAGTCCATCTCGAGG |
| 1576 | CTCGAGATGGACTGCACCA | TGGTGCAGTCCATCTCGAG |
| 1577 | TCGAGATGGACTGCACCAT | ATGGTGCAGTCCATCTCGA |
| 1578 | CGAGATGGACTGCACCATG | CATGGTGCAGTCCATCTCG |
| 1579 | GAGATGGACTGCACCATGG | CCATGGTGCAGTCCATCTC |
| 1580 | AGATGGACTGCACCATGGG | CCCATGGTGCAGTCCATCT |
| 1581 | GATGGACTGCACCATGGGC | GCCCATGGTGCAGTCCATC |
| 1582 | ATGGACTGCACCATGGGCC | GGCCCATGGTGCAGTCCAT |
| 1583 | TGGACTGCACCATGGGCCG | CGGCCCATGGTGCAGTCCA |
| 1584 | GGACTGCACCATGGGCCGC | GCGGCCCATGGTGCAGTCC |
| 1585 | GACTGCACCATGGGCCGCT | AGCGGCCCATGGTGCAGTC |
| 1586 | ACTGCACCATGGGCCGCTG | CAGCGGCCCATGGTGCAGT |
| 1587 | CTGCACCATGGGCCGCTGT | ACAGCGGCCCATGGTGCAG |
| 1588 | TGCACCATGGGCCGCTGTG | CACAGCGGCCCATGGTGCA |
| 1589 | GCACCATGGGCCGCTGTGC | GCACAGCGGCCCATGGTGC |
| 1590 | CACCATGGGCCGCTGTGCC | GGCACAGCGGCCCATGGTG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 1591 | ACCATGGGCCGCTGTGCCT | AGGCACAGCGGCCCATGGT |
| 1592 | CCATGGGCCGCTGTGCCTG | CAGGCACAGCGGCCCATGG |
| 1593 | CATGGGCCGCTGTGCCTGG | CCAGGCACAGCGGCCCATG |
| 1594 | ATGGGCCGCTGTGCCTGGG | CCCAGGCACAGCGGCCCAT |
| 1595 | TGGGCCGCTGTGCCTGGGA | TCCCAGGCACAGCGGCCCA |
| 1596 | GGGCCGCTGTGCCTGGGAG | CTCCCAGGCACAGCGGCCC |
| 1597 | GGCCGCTGTGCCTGGGAGA | TCTCCCAGGCACAGCGGCC |
| 1598 | GCCGCTGTGCCTGGGAGAG | CTCTCCCAGGCACAGCGGC |
| 1599 | CCGCTGTGCCTGGGAGAGC | GCTCTCCCAGGCACAGCGG |
| 1600 | CGCTGTGCCTGGGAGAGCC | GGCTCTCCCAGGCACAGCG |
| 1601 | GCTGTGCCTGGGAGAGCCT | AGGCTCTCCCAGGCACAGC |
| 1602 | CTGTGCCTGGGAGAGCCTG | CAGGCTCTCCCAGGCACAG |
| 1603 | TGTGCCTGGGAGAGCCTGC | GCAGGCTCTCCCAGGCACA |
| 1604 | GTGCCTGGGAGAGCCTGCT | AGCAGGCTCTCCCAGGCAC |
| 1605 | TGCCTGGGAGAGCCTGCTC | GAGCAGGCTCTCCCAGGCA |
| 1606 | GCCTGGGAGAGCCTGCTCC | GGAGCAGGCTCTCCCAGGC |
| 1607 | CCTGGGAGAGCCTGCTCCC | GGGAGCAGGCTCTCCCAGG |
| 1608 | CTGGGAGAGCCTGCTCCCT | AGGGAGCAGGCTCTCCCAG |
| 1609 | TGGGAGAGCCTGCTCCCTT | AAGGGAGCAGGCTCTCCCA |
| 1610 | GGGAGAGCCTGCTCCCTTT | AAAGGGAGCAGGCTCTCCC |
| 1611 | GGAGAGCCTGCTCCCTTTT | AAAAGGGAGCAGGCTCTCC |
| 1612 | GAGAGCCTGCTCCCTTTTG | CAAAAGGGAGCAGGCTCTC |
| 1613 | AGAGCCTGCTCCCTTTTGG | CCAAAAGGGAGCAGGCTCT |
| 1614 | GAGCCTGCTCCCTTTTGGA | TCCAAAAGGGAGCAGGCTC |
| 1615 | AGCCTGCTCCCTTTTGGAG | CTCCAAAAGGGAGCAGGCT |
| 1616 | GCCTGCTCCCTTTTGGAGG | CCTCCAAAAGGGAGCAGGC |
| 1617 | CCTGCTCCCTTTTGGAGGG | CCCTCCAAAAGGGAGCAGG |
| 1618 | CTGCTCCCTTTTGGAGGGG | CCCCTCCAAAAGGGAGCAG |
| 1619 | TGCTCCCTTTTGGAGGGGC | GCCCCTCCAAAAGGGAGCA |
| 1620 | GCTCCCTTTTGGAGGGGCG | CGCCCCTCCAAAAGGGAGC |
| 1621 | CTCCCTTTTGGAGGGGCGT | ACGCCCCTCCAAAAGGGAG |
| 1622 | TCCCTTTTGGAGGGGCGTC | GACGCCCCTCCAAAAGGGA |
| 1623 | CCCTTTTGGAGGGGCGTCC | GGACGCCCCTCCAAAAGGG |
| 1624 | CCTTTTGGAGGGGCGTCCT | AGGACGCCCCTCCAAAAGG |
| 1625 | CTTTTGGAGGGGCGTCCTG | CAGGACGCCCCTCCAAAAG |
| 1626 | TTTTGGAGGGGCGTCCTGA | TCAGGACGCCCCTCCAAAA |
| 1627 | TTTGGAGGGGCGTCCTGAG | CTCAGGACGCCCCTCCAAA |
| 1628 | TTGGAGGGGCGTCCTGAGC | GCTCAGGACGCCCCTCCAA |
| 1629 | TGGAGGGGCGTCCTGAGCA | TGCTCAGGACGCCCCTCCA |
| 1630 | GGAGGGGCGTCCTGAGCAC | GTGCTCAGGACGCCCCTCC |
| 1631 | GAGGGGCGTCCTGAGCACC | GGTGCTCAGGACGCCCCTC |
| 1632 | AGGGGCGTCCTGAGCACCC | GGGTGCTCAGGACGCCCCT |
| 1633 | GGGGCGTCCTGAGCACCCC | GGGGTGCTCAGGACGCCCC |
| 1634 | GGGCGTCCTGAGCACCCCA | TGGGGTGCTCAGGACGCCC |
| 1635 | GGCGTCCTGAGCACCCCAG | CTGGGGTGCTCAGGACGCC |
| 1636 | GCGTCCTGAGCACCCCAGA | TCTGGGGTGCTCAGGACGC |
| 1637 | CGTCCTGAGCACCCCAGAC | GTCTGGGGTGCTCAGGACG |
| 1638 | GTCCTGAGCACCCCAGACT | AGTCTGGGGTGCTCAGGAC |
| 1639 | TCCTGAGCACCCCAGACTC | GAGTCTGGGGTGCTCAGGA |
| 1640 | CCTGAGCACCCCAGACTCC | GGAGTCTGGGGTGCTCAGG |
| 1641 | CTGAGCACCCCAGACTCCT | AGGAGTCTGGGGTGCTCAG |
| 1642 | TGAGCACCCCAGACTCCTG | CAGGAGTCTGGGGTGCTCA |
| 1643 | GAGCACCCCAGACTCCTGG | CCAGGAGTCTGGGGTGCTC |
| 1644 | AGCACCCCAGACTCCTGGC | GCCAGGAGTCTGGGGTGCT |
| 1645 | GCACCCCAGACTCCTGGCT | AGCCAGGAGTCTGGGGTGC |
| 1646 | CACCCCAGACTCCTGGCTT | AAGCCAGGAGTCTGGGGTG |
| 1647 | ACCCCAGACTCCTGGCTTC | GAAGCCAGGAGTCTGGGGT |
| 1648 | CCCCAGACTCCTGGCTTCC | GGAAGCCAGGAGTCTGGGG |
| 1649 | CCCAGACTCCTGGCTTCCC | GGGAAGCCAGGAGTCTGGG |
| 1650 | CCAGACTCCTGGCTTCCCC | GGGGAAGCCAGGAGTCTGG |
| 1651 | CAGACTCCTGGCTTCCCCC | GGGGGAAGCCAGGAGTCTG |
| 1652 | AGACTCCTGGCTTCCCCCT | AGGGGGAAGCCAGGAGTCT |
| 1653 | GACTCCTGGCTTCCCCCTG | CAGGGGGAAGCCAGGAGTC |
| 1654 | ACTCCTGGCTTCCCCCTGG | CCAGGGGGAAGCCAGGAGT |
| 1655 | CTCCTGGCTTCCCCCTGGC | GCCAGGGGGAAGCCAGGAG |
| 1656 | TCCTGGCTTCCCCCTGGCT | AGCCAGGGGGAAGCCAGGA |
| 1657 | CCTGGCTTCCCCCTGGCTT | AAGCCAGGGGGAAGCCAGG |
| 1658 | CTGGCTTCCCCCTGGCTTC | GAAGCCAGGGGGAAGCCAG |
| 1659 | TGGCTTCCCCCTGGCTTCC | GGAAGCCAGGGGGAAGCCA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 1660 | GGCTTCCCCCTGGCTTCCC | GGGAAGCCAGGGGGAAGCC |
| 1661 | GCTTCCCCCTGGCTTCCCC | GGGGAAGCCAGGGGGAAGC |
| 1662 | CTTCCCCCTGGCTTCCCCC | GGGGGAAGCCAGGGGGAAG |
| 1663 | TTCCCCCTGGCTTCCCCCA | TGGGGGAAGCCAGGGGGAA |
| 1664 | TCCCCCTGGCTTCCCCCAG | CTGGGGGAAGCCAGGGGGA |
| 1665 | CCCCCTGGCTTCCCCCAGG | CCTGGGGGAAGCCAGGGGG |
| 1666 | CCCCTGGCTTCCCCCAGGG | CCCTGGGGGAAGCCAGGGG |
| 1667 | CCCTGGCTTCCCCCAGGGC | GCCCTGGGGGAAGCCAGGG |
| 1668 | CCTGGCTTCCCCCAGGGCC | GGCCCTGGGGGAAGCCAGG |
| 1669 | CTGGCTTCCCCCAGGGCCC | GGGCCCTGGGGGAAGCCAG |
| 1670 | TGGCTTCCCCCAGGGCCCC | GGGGCCCTGGGGGAAGCCA |
| 1671 | GGCTTCCCCCAGGGCCCCA | TGGGGCCCTGGGGGAAGCC |
| 1672 | GCTTCCCCCAGGGCCCCAA | TTGGGGCCCTGGGGGAAGC |
| 1673 | CTTCCCCCAGGGCCCCAAG | CTTGGGGCCCTGGGGGAAG |
| 1674 | TTCCCCCAGGGCCCCAAGG | CCTTGGGGCCCTGGGGGAA |
| 1675 | TCCCCCAGGGCCCCAAGGA | TCCTTGGGGCCCTGGGGGA |
| 1676 | CCCCCAGGGCCCCAAGGAC | GTCCTTGGGGCCCTGGGGG |
| 1677 | CCCCAGGGCCCCAAGGACA | TGTCCTTGGGGCCCTGGGG |
| 1678 | CCCAGGGCCCCAAGGACAT | ATGTCCTTGGGGCCCTGGG |
| 1679 | CCAGGGCCCCAAGGACATG | CATGTCCTTGGGGCCCTGG |
| 1680 | CAGGGCCCCAAGGACATGC | GCATGTCCTTGGGGCCCTG |
| 1681 | AGGGCCCCAAGGACATGCT | AGCATGTCCTTGGGGCCCT |
| 1682 | GGGCCCCAAGGACATGCTC | GAGCATGTCCTTGGGGCCC |
| 1683 | GGCCCCAAGGACATGCTCC | GGAGCATGTCCTTGGGGCC |
| 1684 | GCCCCAAGGACATGCTCCC | GGGAGCATGTCCTTGGGGC |
| 1685 | CCCCAAGGACATGCTCCCA | TGGGAGCATGTCCTTGGGG |
| 1686 | CCCAAGGACATGCTCCCAC | GTGGGAGCATGTCCTTGGG |
| 1687 | CCAAGGACATGCTCCCACT | AGTGGGAGCATGTCCTTGG |
| 1688 | CAAGGACATGCTCCCACTT | AAGTGGGAGCATGTCCTTG |
| 1689 | AAGGACATGCTCCCACTTG | CAAGTGGGAGCATGTCCTT |
| 1690 | AGGACATGCTCCCACTTGT | ACAAGTGGGAGCATGTCCT |
| 1691 | GGACATGCTCCCACTTGTG | CACAAGTGGGAGCATGTCC |
| 1692 | GACATGCTCCCACTTGTGG | CCACAAGTGGGAGCATGTC |
| 1693 | ACATGCTCCCACTTGTGGA | TCCACAAGTGGGAGCATGT |
| 1694 | CATGCTCCCACTTGTGGAG | CTCCACAAGTGGGAGCATG |
| 1695 | ATGCTCCCACTTGTGGAGG | CCTCCACAAGTGGGAGCAT |
| 1696 | TGCTCCCACTTGTGGAGGG | CCCTCCACAAGTGGGAGCA |
| 1697 | GCTCCCACTTGTGGAGGGC | GCCCTCCACAAGTGGGAGC |
| 1698 | CTCCCACTTGTGGAGGGCG | CGCCCTCCACAAGTGGGAG |
| 1699 | TCCCACTTGTGGAGGGCGA | TCGCCCTCCACAAGTGGGA |
| 1700 | CCCACTTGTGGAGGGCGAG | CTCGCCCTCCACAAGTGGG |
| 1701 | CCACTTGTGGAGGGCGAGG | CCTCGCCCTCCACAAGTGG |
| 1702 | CACTTGTGGAGGGCGAGGG | CCCTCGCCCTCCACAAGTG |
| 1703 | ACTTGTGGAGGGCGAGGGC | GCCCTCGCCCTCCACAAGT |
| 1704 | CTTGTGGAGGGCGAGGGCC | GGCCCTCGCCCTCCACAAG |
| 1705 | TTGTGGAGGGCGAGGGCCC | GGGCCCTCGCCCTCCACAA |
| 1706 | TGTGGAGGGCGAGGGCCCC | GGGGCCCTCGCCCTCCACA |
| 1707 | GTGGAGGGCGAGGGCCCCC | GGGGGCCCTCGCCCTCCAC |
| 1708 | TGGAGGGCGAGGGCCCCCA | TGGGGGCCCTCGCCCTCCA |
| 1709 | GGAGGGCGAGGGCCCCCAG | CTGGGGGCCCTCGCCCTCC |
| 1710 | GAGGGCGAGGGCCCCCAGA | TCTGGGGGCCCTCGCCCTC |
| 1711 | AGGGCGAGGGCCCCCAGAA | TTCTGGGGGCCCTCGCCCT |
| 1712 | GGGCGAGGGCCCCCAGAAT | ATTCTGGGGGCCCTCGCCC |
| 1713 | GGCGAGGGCCCCCAGAATG | CATTCTGGGGGCCCTCGCC |
| 1714 | GCGAGGGCCCCCAGAATGG | CCATTCTGGGGGCCCTCGC |
| 1715 | CGAGGGCCCCCAGAATGGG | CCCATTCTGGGGGCCCTCG |
| 1716 | GAGGGCCCCCAGAATGGGG | CCCCATTCTGGGGGCCCTC |
| 1717 | AGGGCCCCCAGAATGGGGA | TCCCCATTCTGGGGGCCCT |
| 1718 | GGGCCCCCAGAATGGGGAG | CTCCCCATTCTGGGGGCCC |
| 1719 | GGCCCCCAGAATGGGGAGA | TCTCCCCATTCTGGGGGCC |
| 1720 | GCCCCCAGAATGGGGAGAG | CTCTCCCCATTCTGGGGGC |
| 1721 | CCCCCAGAATGGGGAGAGG | CCTCTCCCCATTCTGGGGG |
| 1722 | CCCCAGAATGGGGAGAGGA | TCCTCTCCCCATTCTGGGG |
| 1723 | CCCAGAATGGGGAGAGGAA | TTCCTCTCCCCATTCTGGG |
| 1724 | CCAGAATGGGGAGAGGAAG | CTTCCTCTCCCCATTCTGG |
| 1725 | CAGAATGGGGAGAGGAAGG | CCTTCCTCTCCCCATTCTG |
| 1726 | AGAATGGGGAGAGGAAGGT | ACCTTCCTCTCCCCATTCT |
| 1727 | GAATGGGGAGAGGAAGGTC | GACCTTCCTCTCCCCATTC |
| 1728 | AATGGGGAGAGGAAGGTCA | TGACCTTCCTCTCCCCATT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 1729 | ATGGGGAGAGGAAGGTCAA | TTGACCTTCCTCTCCCCAT |
| 1730 | TGGGGAGAGGAAGGTCAAC | GTTGACCTTCCTCTCCCCA |
| 1731 | GGGGAGAGGAAGGTCAACT | AGTTGACCTTCCTCTCCCC |
| 1732 | GGGAGAGGAAGGTCAACTG | CAGTTGACCTTCCTCTCCC |
| 1733 | GGAGAGGAAGGTCAACTGG | CCAGTTGACCTTCCTCTCC |
| 1734 | GAGAGGAAGGTCAACTGGC | GCCAGTTGACCTTCCTCTC |
| 1735 | AGAGGAAGGTCAACTGGCT | AGCCAGTTGACCTTCCTCT |
| 1736 | GAGGAAGGTCAACTGGCTG | CAGCCAGTTGACCTTCCTC |
| 1737 | AGGAAGGTCAACTGGCTGG | CCAGCCAGTTGACCTTCCT |
| 1738 | GGAAGGTCAACTGGCTGGG | CCCAGCCAGTTGACCTTCC |
| 1739 | GAAGGTCAACTGGCTGGGC | GCCCAGCCAGTTGACCTTC |
| 1740 | AAGGTCAACTGGCTGGGCA | TGCCCAGCCAGTTGACCTT |
| 1741 | AGGTCAACTGGCTGGGCAG | CTGCCCAGCCAGTTGACCT |
| 1742 | GGTCAACTGGCTGGGCAGC | GCTGCCCAGCCAGTTGACC |
| 1743 | GTCAACTGGCTGGGCAGCA | TGCTGCCCAGCCAGTTGAC |
| 1744 | TCAACTGGCTGGGCAGCAA | TTGCTGCCCAGCCAGTTGA |
| 1745 | CAACTGGCTGGGCAGCAAA | TTTGCTGCCCAGCCAGTTG |
| 1746 | AACTGGCTGGGCAGCAAAG | CTTTGCTGCCCAGCCAGTT |
| 1747 | ACTGGCTGGGCAGCAAAGA | TCTTTGCTGCCCAGCCAGT |
| 1748 | CTGGCTGGGCAGCAAAGAG | CTCTTTGCTGCCCAGCCAG |
| 1749 | TGGCTGGGCAGCAAAGAGG | CCTCTTTGCTGCCCAGCCA |
| 1750 | GGCTGGGCAGCAAAGAGGG | CCCTCTTTGCTGCCCAGCC |
| 1751 | GCTGGGCAGCAAAGAGGGA | TCCCTCTTTGCTGCCCAGC |
| 1752 | CTGGGCAGCAAAGAGGGAC | GTCCCTCTTTGCTGCCCAG |
| 1753 | TGGGCAGCAAAGAGGGACT | AGTCCCTCTTTGCTGCCCA |
| 1754 | GGGCAGCAAAGAGGGACTG | CAGTCCCTCTTTGCTGCCC |
| 1755 | GGCAGCAAAGAGGGACTGC | GCAGTCCCTCTTTGCTGCC |
| 1756 | GCAGCAAAGAGGGACTGCG | CGCAGTCCCTCTTTGCTGC |
| 1757 | CAGCAAAGAGGGACTGCGC | GCGCAGTCCCTCTTTGCTG |
| 1758 | AGCAAAGAGGGACTGCGCT | AGCGCAGTCCCTCTTTGCT |
| 1759 | GCAAAGAGGGACTGCGCTG | CAGCGCAGTCCCTCTTTGC |
| 1760 | CAAAGAGGGACTGCGCTGG | CCAGCGCAGTCCCTCTTTG |
| 1761 | AAAGAGGGACTGCGCTGGA | TCCAGCGCAGTCCCTCTTT |
| 1762 | AAGAGGGACTGCGCTGGAA | TTCCAGCGCAGTCCCTCTT |
| 1763 | AGAGGGACTGCGCTGGAAG | CTTCCAGCGCAGTCCCTCT |
| 1764 | GAGGGACTGCGCTGGAAGG | CCTTCCAGCGCAGTCCCTC |
| 1765 | AGGGACTGCGCTGGAAGGA | TCCTTCCAGCGCAGTCCCT |
| 1766 | GGGACTGCGCTGGAAGGAG | CTCCTTCCAGCGCAGTCCC |
| 1767 | GGACTGCGCTGGAAGGAGG | CCTCCTTCCAGCGCAGTCC |
| 1768 | GACTGCGCTGGAAGGAGGC | GCCTCCTTCCAGCGCAGTC |
| 1769 | ACTGCGCTGGAAGGAGGCC | GGCCTCCTTCCAGCGCAGT |
| 1770 | CTGCGCTGGAAGGAGGCCA | TGGCCTCCTTCCAGCGCAG |
| 1771 | TGCGCTGGAAGGAGGCCAT | ATGGCCTCCTTCCAGCGCA |
| 1772 | GCGCTGGAAGGAGGCCATG | CATGGCCTCCTTCCAGCGC |
| 1773 | CGCTGGAAGGAGGCCATGC | GCATGGCCTCCTTCCAGCG |
| 1774 | GCTGGAAGGAGGCCATGCT | AGCATGGCCTCCTTCCAGC |
| 1775 | CTGGAAGGAGGCCATGCTT | AAGCATGGCCTCCTTCCAG |
| 1776 | TGGAAGGAGGCCATGCTTA | TAAGCATGGCCTCCTTCCA |
| 1777 | GGAAGGAGGCCATGCTTAC | GTAAGCATGGCCTCCTTCC |
| 1778 | GAAGGAGGCCATGCTTACC | GGTAAGCATGGCCTCCTTC |
| 1779 | AAGGAGGCCATGCTTACCC | GGGTAAGCATGGCCTCCTT |
| 1780 | AGGAGGCCATGCTTACCCA | TGGGTAAGCATGGCCTCCT |
| 1781 | GGAGGCCATGCTTACCCAT | ATGGGTAAGCATGGCCTCC |
| 1782 | GAGGCCATGCTTACCCATC | GATGGGTAAGCATGGCCTC |
| 1783 | AGGCCATGCTTACCCATCC | GGATGGGTAAGCATGGCCT |
| 1784 | GGCCATGCTTACCCATCCG | CGGATGGGTAAGCATGGCC |
| 1785 | GCCATGCTTACCCATCCGC | GCGGATGGGTAAGCATGGC |
| 1786 | CCATGCTTACCCATCCGCT | AGCGGATGGGTAAGCATGG |
| 1787 | CATGCTTACCCATCCGCTG | CAGCGGATGGGTAAGCATG |
| 1788 | ATGCTTACCCATCCGCTGG | CCAGCGGATGGGTAAGCAT |
| 1789 | TGCTTACCCATCCGCTGGC | GCCAGCGGATGGGTAAGCA |
| 1790 | GCTTACCCATCCGCTGGCA | TGCCAGCGGATGGGTAAGC |
| 1791 | CTTACCCATCCGCTGGCAT | ATGCCAGCGGATGGGTAAG |
| 1792 | TTACCCATCCGCTGGCATT | AATGCCAGCGGATGGGTAA |
| 1793 | TACCCATCCGCTGGCATTC | GAATGCCAGCGGATGGGTA |
| 1794 | ACCCATCCGCTGGCATTCT | AGAATGCCAGCGGATGGGT |
| 1795 | CCCATCCGCTGGCATTCTG | CAGAATGCCAGCGGATGGG |
| 1796 | CCATCCGCTGGCATTCTGC | GCAGAATGCCAGCGGATGG |
| 1797 | CATCCGCTGGCATTCTGCG | CGCAGAATGCCAGCGGATG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X - 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1798 | ATCCGCTGGCATTCTGCGG | CCGCAGAATGCCAGCGGAT |
| 1799 | TCCGCTGGCATTCTGCGGG | CCCGCAGAATGCCAGCGGA |
| 1800 | CCGCTGGCATTCTGCGGGC | GCCCGCAGAATGCCAGCGG |
| 1801 | CGCTGGCATTCTGCGGGCC | GGCCCGCAGAATGCCAGCG |
| 1802 | GCTGGCATTCTGCGGGCCA | TGGCCCGCAGAATGCCAGC |
| 1803 | CTGGCATTCTGCGGGCCAG | CTGGCCCGCAGAATGCCAG |
| 1804 | TGGCATTCTGCGGGCCAGC | GCTGGCCCGCAGAATGCCA |
| 1805 | GGCATTCTGCGGGCCAGCG | CGCTGGCCCGCAGAATGCC |
| 1806 | GCATTCTGCGGGCCAGCGT | ACGCTGGCCCGCAGAATGC |
| 1807 | CATTCTGCGGGCCAGCGTG | CACGCTGGCCCGCAGAATG |
| 1808 | ATTCTGCGGGCCAGCGTGC | GCACGCTGGCCCGCAGAAT |
| 1809 | TTCTGCGGGCCAGCGTGCC | GGCACGCTGGCCCGCAGAA |
| 1810 | TCTGCGGGCCAGCGTGCCC | GGGCACGCTGGCCCGCAGA |
| 1811 | CTGCGGGCCAGCGTGCCCA | TGGGCACGCTGGCCCGCAG |
| 1812 | TGCGGGCCAGCGTGCCCAC | GTGGGCACGCTGGCCCGCA |
| 1813 | GCGGGCCAGCGTGCCCACC | GGTGGGCACGCTGGCCCGC |
| 1814 | CGGGCCAGCGTGCCCACCT | AGGTGGGCACGCTGGCCCG |
| 1815 | GGGCCAGCGTGCCCACCTC | GAGGTGGGCACGCTGGCCC |
| 1816 | GGCCAGCGTGCCCACCTCG | CGAGGTGGGCACGCTGGCC |
| 1817 | GCCAGCGTGCCCACCTCGC | GCGAGGTGGGCACGCTGGC |
| 1818 | CCAGCGTGCCCACCTCGCT | AGCGAGGTGGGCACGCTGG |
| 1819 | CAGCGTGCCCACCTCGCTG | CAGCGAGGTGGGCACGCTG |
| 1820 | AGCGTGCCCACCTCGCTGT | ACAGCGAGGTGGGCACGCT |
| 1821 | GCGTGCCCACCTCGCTGTG | CACAGCGAGGTGGGCACGC |
| 1822 | CGTGCCCACCTCGCTGTGG | CCACAGCGAGGTGGGCACG |
| 1823 | GTGCCCACCTCGCTGTGGC | GCCACAGCGAGGTGGGCAC |
| 1824 | TGCCCACCTCGCTGTGGCC | GGCCACAGCGAGGTGGGCA |
| 1825 | GCCCACCTCGCTGTGGCCC | GGGCCACAGCGAGGTGGGC |
| 1826 | CCCACCTCGCTGTGGCCCC | GGGGCCACAGCGAGGTGGG |
| 1827 | CCACCTCGCTGTGGCCCCC | GGGGGCCACAGCGAGGTGG |
| 1828 | CACCTCGCTGTGGCCCCCT | AGGGGGCCACAGCGAGGTG |
| 1829 | ACCTCGCTGTGGCCCCCTG | CAGGGGGCCACAGCGAGGT |
| 1830 | CCTCGCTGTGGCCCCCTGA | TCAGGGGGCCACAGCGAGG |
| 1831 | CTCGCTGTGGCCCCCTGAT | ATCAGGGGGCCACAGCGAG |
| 1832 | TCGCTGTGGCCCCCTGATG | CATCAGGGGGCCACAGCGA |
| 1833 | CGCTGTGGCCCCCTGATGC | GCATCAGGGGGCCACAGCG |
| 1834 | GCTGTGGCCCCCTGATGCC | GGCATCAGGGGGCCACAGC |
| 1835 | CTGTGGCCCCCTGATGCCT | AGGCATCAGGGGGCCACAG |
| 1836 | TGTGGCCCCCTGATGCCTG | CAGGCATCAGGGGGCCACA |
| 1837 | GTGGCCCCCTGATGCCTGA | TCAGGCATCAGGGGGCCAC |
| 1838 | TGGCCCCCTGATGCCTGAG | CTCAGGCATCAGGGGGCCA |
| 1839 | GGCCCCCTGATGCCTGAGC | GCTCAGGCATCAGGGGGCC |
| 1840 | GCCCCCTGATGCCTGAGCA | TGCTCAGGCATCAGGGGGC |
| 1841 | CCCCCTGATGCCTGAGCAT | ATGCTCAGGCATCAGGGGG |
| 1842 | CCCCTGATGCCTGAGCATA | TATGCTCAGGCATCAGGGG |
| 1843 | CCCTGATGCCTGAGCATAG | CTATGCTCAGGCATCAGGG |
| 1844 | CCTGATGCCTGAGCATAGT | ACTATGCTCAGGCATCAGG |
| 1845 | CTGATGCCTGAGCATAGTG | CACTATGCTCAGGCATCAG |
| 1846 | TGATGCCTGAGCATAGTGG | CCACTATGCTCAGGCATCA |
| 1847 | GATGCCTGAGCATAGTGGT | ACCACTATGCTCAGGCATC |
| 1848 | ATGCCTGAGCATAGTGGTG | CACCACTATGCTCAGGCAT |
| 1849 | TGCCTGAGCATAGTGGTGG | CCACCACTATGCTCAGGCA |
| 1850 | GCCTGAGCATAGTGGTGGC | GCCACCACTATGCTCAGGC |
| 1851 | CCTGAGCATAGTGGTGGCC | GGCCACCACTATGCTCAGG |
| 1852 | CTGAGCATAGTGGTGGCCA | TGGCCACCACTATGCTCAG |
| 1853 | TGAGCATAGTGGTGGCCAT | ATGGCCACCACTATGCTCA |
| 1854 | GAGCATAGTGGTGGCCATC | GATGGCCACCACTATGCTC |
| 1855 | AGCATAGTGGTGGCCATCT | AGATGGCCACCACTATGCT |
| 1856 | GCATAGTGGTGGCCATCTC | GAGATGGCCACCACTATGC |
| 1857 | CATAGTGGTGGCCATCTCA | TGAGATGGCCACCACTATG |
| 1858 | ATAGTGGTGGCCATCTCAA | TTGAGATGGCCACCACTAT |
| 1859 | TAGTGGTGGCCATCTCAAG | CTTGAGATGGCCACCACTA |
| 1860 | AGTGGTGGCCATCTCAAGA | TCTTGAGATGGCCACCACT |
| 1861 | GTGGTGGCCATCTCAAGAG | CTCTTGAGATGGCCACCAC |
| 1862 | TGGTGGCCATCTCAAGAGT | ACTCTTGAGATGGCCACCA |
| 1863 | GGTGGCCATCTCAAGAGTG | CACTCTTGAGATGGCCACC |
| 1864 | GTGGCCATCTCAAGAGTGA | TCACTCTTGAGATGGCCAC |
| 1865 | TGGCCATCTCAAGAGTGAC | GTCACTCTTGAGATGGCCA |
| 1866 | GGCCATCTCAAGAGTGACC | GGTCACTCTTGAGATGGCC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X – 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1867 | GCCATCTCAAGAGTGACCC | GGGTCACTCTTGAGATGGC |
| 1868 | CCATCTCAAGAGTGACCCT | AGGGTCACTCTTGAGATGG |
| 1869 | CATCTCAAGAGTGACCCTG | CAGGGTCACTCTTGAGATG |
| 1870 | ATCTCAAGAGTGACCCTGT | ACAGGGTCACTCTTGAGAT |
| 1871 | TCTCAAGAGTGACCCTGTG | CACAGGGTCACTCTTGAGA |
| 1872 | CTCAAGAGTGACCCTGTGG | CCACAGGGTCACTCTTGAG |
| 1873 | TCAAGAGTGACCCTGTGGC | GCCACAGGGTCACTCTTGA |
| 1874 | CAAGAGTGACCCTGTGGCC | GGCCACAGGGTCACTCTTG |
| 1875 | AAGAGTGACCCTGTGGCCT | AGGCCACAGGGTCACTCTT |
| 1876 | AGAGTGACCCTGTGGCCTT | AAGGCCACAGGGTCACTCT |
| 1877 | GAGTGACCCTGTGGCCTTC | GAAGGCCACAGGGTCACTC |
| 1878 | AGTGACCCTGTGGCCTTCC | GGAAGGCCACAGGGTCACT |
| 1879 | GTGACCCTGTGGCCTTCCG | CGGAAGGCCACAGGGTCAC |
| 1880 | TGACCCTGTGGCCTTCCGG | CCGGAAGGCCACAGGGTCA |
| 1881 | GACCCTGTGGCCTTCCGGC | GCCGGAAGGCCACAGGGTC |
| 1882 | ACCCTGTGGCCTTCCGGCC | GGCCGGAAGGCCACAGGGT |
| 1883 | CCCTGTGGCCTTCCGGCCC | GGGCCGGAAGGCCACAGGG |
| 1884 | CCTGTGGCCTTCCGGCCCT | AGGGCCGGAAGGCCACAGG |
| 1885 | CTGTGGCCTTCCGGCCCTG | CAGGGCCGGAAGGCCACAG |
| 1886 | TGTGGCCTTCCGGCCCTGG | CCAGGGCCGGAAGGCCACA |
| 1887 | GTGGCCTTCCGGCCCTGGC | GCCAGGGCCGGAAGGCCAC |
| 1888 | TGGCCTTCCGGCCCTGGCA | TGCCAGGGCCGGAAGGCCA |
| 1889 | GGCCTTCCGGCCCTGGCAC | GTGCCAGGGCCGGAAGGCC |
| 1890 | GCCTTCCGGCCCTGGCACT | AGTGCCAGGGCCGGAAGGC |
| 1891 | CCTTCCGGCCCTGGCACTG | CAGTGCCAGGGCCGGAAGG |
| 1892 | CTTCCGGCCCTGGCACTGC | GCAGTGCCAGGGCCGGAAG |
| 1893 | TTCCGGCCCTGGCACTGCC | GGCAGTGCCAGGGCCGGAA |
| 1894 | TCCGGCCCTGGCACTGCCC | GGGCAGTGCCAGGGCCGGA |
| 1895 | CCGGCCCTGGCACTGCCCT | AGGGCAGTGCCAGGGCCGG |
| 1896 | CGGCCCTGGCACTGCCCTT | AAGGGCAGTGCCAGGGCCG |
| 1897 | GGCCCTGGCACTGCCCTTT | AAAGGGCAGTGCCAGGGCC |
| 1898 | GCCCTGGCACTGCCCTTTC | GAAAGGGCAGTGCCAGGGC |
| 1899 | CCCTGGCACTGCCCTTTCC | GGAAAGGGCAGTGCCAGGG |
| 1900 | CCTGGCACTGCCCTTTCCT | AGGAAAGGGCAGTGCCAGG |
| 1901 | CTGGCACTGCCCTTTCCTT | AAGGAAAGGGCAGTGCCAG |
| 1902 | TGGCACTGCCCTTTCCTTC | GAAGGAAAGGGCAGTGCCA |
| 1903 | GGCACTGCCCTTTCCTTCT | AGAAGGAAAGGGCAGTGCC |
| 1904 | GCACTGCCCTTTCCTTCTG | CAGAAGGAAAGGGCAGTGC |
| 1905 | CACTGCCCTTTCCTTCTGG | CCAGAAGGAAAGGGCAGTG |
| 1906 | ACTGCCCTTTCCTTCTGGA | TCCAGAAGGAAAGGGCAGT |
| 1907 | CTGCCCTTTCCTTCTGGAG | CTCCAGAAGGAAAGGGCAG |
| 1908 | TGCCCTTTCCTTCTGGAGA | TCTCCAGAAGGAAAGGGCA |
| 1909 | GCCCTTTCCTTCTGGAGAC | GTCTCCAGAAGGAAAGGGC |
| 1910 | CCCTTTCCTTCTGGAGACC | GGTCTCCAGAAGGAAAGGG |
| 1911 | CCTTTCCTTCTGGAGACCA | TGGTCTCCAGAAGGAAAGG |
| 1912 | CTTTCCTTCTGGAGACCAA | TTGGTCTCCAGAAGGAAAG |
| 1913 | TTTCCTTCTGGAGACCAAG | CTTGGTCTCCAGAAGGAAA |
| 1914 | TTCCTTCTGGAGACCAAGA | TCTTGGTCTCCAGAAGGAA |
| 1915 | TCCTTCTGGAGACCAAGAT | ATCTTGGTCTCCAGAAGGA |
| 1916 | CCTTCTGGAGACCAAGATC | GATCTTGGTCTCCAGAAGG |
| 1917 | CTTCTGGAGACCAAGATCC | GGATCTTGGTCTCCAGAAG |
| 1918 | TTCTGGAGACCAAGATCCT | AGGATCTTGGTCTCCAGAA |
| 1919 | TCTGGAGACCAAGATCCTG | CAGGATCTTGGTCTCCAGA |
| 1920 | CTGGAGACCAAGATCCTGG | CCAGGATCTTGGTCTCCAG |
| 1921 | TGGAGACCAAGATCCTGGA | TCCAGGATCTTGGTCTCCA |
| 1922 | GGAGACCAAGATCCTGGAG | CTCCAGGATCTTGGTCTCC |
| 1923 | GAGACCAAGATCCTGGAGC | GCTCCAGGATCTTGGTCTC |
| 1924 | AGACCAAGATCCTGGAGCG | CGCTCCAGGATCTTGGTCT |
| 1925 | GACCAAGATCCTGGAGCGA | TCGCTCCAGGATCTTGGTC |
| 1926 | ACCAAGATCCTGGAGCGAG | CTCGCTCCAGGATCTTGGT |
| 1927 | CCAAGATCCTGGAGCGAGC | GCTCGCTCCAGGATCTTGG |
| 1928 | CAAGATCCTGGAGCGAGCT | AGCTCGCTCCAGGATCTTG |
| 1929 | AAGATCCTGGAGCGAGCTC | GAGCTCGCTCCAGGATCTT |
| 1930 | AGATCCTGGAGCGAGCTCC | GGAGCTCGCTCCAGGATCT |
| 1931 | GATCCTGGAGCGAGCTCCC | GGGAGCTCGCTCCAGGATC |
| 1932 | ATCCTGGAGCGAGCTCCCT | AGGGAGCTCGCTCCAGGAT |
| 1933 | TCCTGGAGCGAGCTCCCTT | AAGGGAGCTCGCTCCAGGA |
| 1934 | CCTGGAGCGAGCTCCCTTC | GAAGGGAGCTCGCTCCAGG |
| 1935 | CTGGAGCGAGCTCCCTTCT | AGAAGGGAGCTCGCTCCAG |

TABLE 1-continued cDNA Human Hairless 19-mer Target Sequences and Complement Referenced to NM_005144-
*Homo sapiens* hairless homolog (mouse) (HR), transcript variant 1, complete mRNA (1-5699 bp).
(SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 1936 | TGGAGCGAGCTCCCTTCTG | CAGAAGGGAGCTCGCTCCA |
| 1937 | GGAGCGAGCTCCCTTCTGG | CCAGAAGGGAGCTCGCTCC |
| 1938 | GAGCGAGCTCCCTTCTGGG | CCCAGAAGGGAGCTCGCTC |
| 1939 | AGCGAGCTCCCTTCTGGGT | ACCCAGAAGGGAGCTCGCT |
| 1940 | GCGAGCTCCCTTCTGGGTG | CACCCAGAAGGGAGCTCGC |
| 1941 | CGAGCTCCCTTCTGGGTGC | GCACCCAGAAGGGAGCTCG |
| 1942 | GAGCTCCCTTCTGGGTGCC | GGCACCCAGAAGGGAGCTC |
| 1943 | AGCTCCCTTCTGGGTGCCC | GGGCACCCAGAAGGGAGCT |
| 1944 | GCTCCCTTCTGGGTGCCCA | TGGGCACCCAGAAGGGAGC |
| 1945 | CTCCCTTCTGGGTGCCCAC | GTGGGCACCCAGAAGGGAG |
| 1946 | TCCCTTCTGGGTGCCCACC | GGTGGGCACCCAGAAGGGA |
| 1947 | CCCTTCTGGGTGCCCACCT | AGGTGGGCACCCAGAAGGG |
| 1948 | CCTTCTGGGTGCCCACCTG | CAGGTGGGCACCCAGAAGG |
| 1949 | CTTCTGGGTGCCCACCTGC | GCAGGTGGGCACCCAGAAG |
| 1950 | TTCTGGGTGCCCACCTGCT | AGCAGGTGGGCACCCAGAA |
| 1951 | TCTGGGTGCCCACCTGCTT | AAGCAGGTGGGCACCCAGA |
| 1952 | CTGGGTGCCCACCTGCTTG | CAAGCAGGTGGGCACCCAG |
| 1953 | TGGGTGCCCACCTGCTTGC | GCAAGCAGGTGGGCACCCA |
| 1954 | GGGTGCCCACCTGCTTGCC | GGCAAGCAGGTGGGCACCC |
| 1955 | GGTGCCCACCTGCTTGCCA | TGGCAAGCAGGTGGGCACC |
| 1956 | GTGCCCACCTGCTTGCCAC | GTGGCAAGCAGGTGGGCAC |
| 1957 | TGCCCACCTGCTTGCCACC | GGTGGCAAGCAGGTGGGCA |
| 1958 | GCCCACCTGCTTGCCACCC | GGGTGGCAAGCAGGTGGGC |
| 1959 | CCCACCTGCTTGCCACCCT | AGGGTGGCAAGCAGGTGGG |
| 1960 | CCACCTGCTTGCCACCCTA | TAGGGTGGCAAGCAGGTGG |
| 1961 | CACCTGCTTGCCACCCTAC | GTAGGGTGGCAAGCAGGTG |
| 1962 | ACCTGCTTGCCACCCTACC | GGTAGGGTGGCAAGCAGGT |
| 1963 | CCTGCTTGCCACCCTACCT | AGGTAGGGTGGCAAGCAGG |
| 1964 | CTGCTTGCCACCCTACCTA | TAGGTAGGGTGGCAAGCAG |
| 1965 | TGCTTGCCACCCTACCTAG | CTAGGTAGGGTGGCAAGCA |
| 1966 | GCTTGCCACCCTACCTAGT | ACTAGGTAGGGTGGCAAGC |
| 1967 | CTTGCCACCCTACCTAGTG | CACTAGGTAGGGTGGCAAG |
| 1968 | TTGCCACCCTACCTAGTGT | ACACTAGGTAGGGTGGCAA |
| 1969 | TGCCACCCTACCTAGTGTC | GACACTAGGTAGGGTGGCA |
| 1970 | GCCACCCTACCTAGTGTCT | AGACACTAGGTAGGGTGGC |
| 1971 | CCACCCTACCTAGTGTCTG | CAGACACTAGGTAGGGTGG |
| 1972 | CACCCTACCTAGTGTCTGG | CCAGACACTAGGTAGGGTG |
| 1973 | ACCCTACCTAGTGTCTGGC | GCCAGACACTAGGTAGGGT |
| 1974 | CCCTACCTAGTGTCTGGCC | GGCCAGACACTAGGTAGGG |
| 1975 | CCTACCTAGTGTCTGGCCT | AGGCCAGACACTAGGTAGG |
| 1976 | CTACCTAGTGTCTGGCCTG | CAGGCCAGACACTAGGTAG |
| 1977 | TACCTAGTGTCTGGCCTGC | GCAGGCCAGACACTAGGTA |
| 1978 | ACCTAGTGTCTGGCCTGCC | GGCAGGCCAGACACTAGGT |
| 1979 | CCTAGTGTCTGGCCTGCCC | GGGCAGGCCAGACACTAGG |
| 1980 | CTAGTGTCTGGCCTGCCCC | GGGGCAGGCCAGACACTAG |
| 1981 | TAGTGTCTGGCCTGCCCCC | GGGGGCAGGCCAGACACTA |
| 1982 | AGTGTCTGGCCTGCCCCCA | TGGGGGCAGGCCAGACACT |
| 1983 | GTGTCTGGCCTGCCCCCAG | CTGGGGGCAGGCCAGACAC |
| 1984 | TGTCTGGCCTGCCCCCAGA | TCTGGGGGCAGGCCAGACA |
| 1985 | GTCTGGCCTGCCCCCAGAG | CTCTGGGGGCAGGCCAGAC |
| 1986 | TCTGGCCTGCCCCCAGAGC | GCTCTGGGGGCAGGCCAGA |
| 1987 | CTGGCCTGCCCCCAGAGCA | TGCTCTGGGGGCAGGCCAG |
| 1988 | TGGCCTGCCCCCAGAGCAT | ATGCTCTGGGGGCAGGCCA |
| 1989 | GGCCTGCCCCCAGAGCATC | GATGCTCTGGGGGCAGGCC |
| 1990 | GCCTGCCCCCAGAGCATCC | GGATGCTCTGGGGGCAGGC |
| 1991 | CCTGCCCCCAGAGCATCCA | TGGATGCTCTGGGGGCAGG |
| 1992 | CTGCCCCCAGAGCATCCAT | ATGGATGCTCTGGGGGCAG |
| 1993 | TGCCCCCAGAGCATCCATG | CATGGATGCTCTGGGGGCA |
| 1994 | GCCCCCAGAGCATCCATGT | ACATGGATGCTCTGGGGGC |
| 1995 | CCCCCAGAGCATCCATGTG | CACATGGATGCTCTGGGGG |
| 1996 | CCCCAGAGCATCCATGTGA | TCACATGGATGCTCTGGGG |
| 1997 | CCCAGAGCATCCATGTGAC | GTCACATGGATGCTCTGGG |
| 1998 | CCAGAGCATCCATGTGACT | AGTCACATGGATGCTCTGG |
| 1999 | CAGAGCATCCATGTGACTG | CAGTCACATGGATGCTCTG |
| 2000 | AGAGCATCCATGTGACTGG | CCAGTCACATGGATGCTCT |
| 2001 | GAGCATCCATGTGACTGGC | GCCAGTCACATGGATGCTC |
| 2002 | AGCATCCATGTGACTGGCC | GGCCAGTCACATGGATGCT |
| 2003 | GCATCCATGTGACTGGCCC | GGGCCAGTCACATGGATGC |
| 2004 | CATCCATGTGACTGGCCCC | GGGGCCAGTCACATGGATG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X – 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2005 | ATCCATGTGACTGGCCCCT | AGGGGCCAGTCACATGGAT |
| 2006 | TCCATGTGACTGGCCCCTG | CAGGGGCCAGTCACATGGA |
| 2007 | CCATGTGACTGGCCCCTGA | TCAGGGGCCAGTCACATGG |
| 2008 | CATGTGACTGGCCCCTGAC | GTCAGGGGCCAGTCACATG |
| 2009 | ATGTGACTGGCCCCTGACC | GGTCAGGGGCCAGTCACAT |
| 2010 | TGTGACTGGCCCCTGACCC | GGGTCAGGGGCCAGTCACA |
| 2011 | GTGACTGGCCCCTGACCCC | GGGGTCAGGGGCCAGTCAC |
| 2012 | TGACTGGCCCCTGACCCCG | CGGGGTCAGGGGCCAGTCA |
| 2013 | GACTGGCCCCTGACCCCGC | GCGGGGTCAGGGGCCAGTC |
| 2014 | ACTGGCCCCTGACCCCGCA | TGCGGGGTCAGGGGCCAGT |
| 2015 | CTGGCCCCTGACCCCGCAC | GTGCGGGGTCAGGGGCCAG |
| 2016 | TGGCCCCTGACCCCGCACC | GGTGCGGGGTCAGGGGCCA |
| 2017 | GGCCCCTGACCCCGCACCC | GGGTGCGGGGTCAGGGGCC |
| 2018 | GCCCCTGACCCCGCACCCC | GGGGTGCGGGGTCAGGGGC |
| 2019 | CCCCTGACCCCGCACCCCT | AGGGGTGCGGGGTCAGGGG |
| 2020 | CCCTGACCCCGCACCCCTG | CAGGGGTGCGGGGTCAGGG |
| 2021 | CCTGACCCCGCACCCCTGG | CCAGGGGTGCGGGGTCAGG |
| 2022 | CTGACCCCGCACCCCTGGG | CCCAGGGGTGCGGGGTCAG |
| 2023 | TGACCCCGCACCCCTGGGT | ACCCAGGGGTGCGGGGTCA |
| 2024 | GACCCCGCACCCCTGGGTA | TACCCAGGGGTGCGGGGTC |
| 2025 | ACCCCGCACCCCTGGGTAT | ATACCCAGGGGTGCGGGGT |
| 2026 | CCCCGCACCCCTGGGTATA | TATACCCAGGGGTGCGGGG |
| 2027 | CCCGCACCCCTGGGTATAC | GTATACCCAGGGGTGCGGG |
| 2028 | CCGCACCCCTGGGTATACT | AGTATACCCAGGGGTGCGG |
| 2029 | CGCACCCCTGGGTATACTC | GAGTATACCCAGGGGTGCG |
| 2030 | GCACCCCTGGGTATACTCC | GGAGTATACCCAGGGGTGC |
| 2031 | CACCCCTGGGTATACTCCG | CGGAGTATACCCAGGGGTG |
| 2032 | ACCCCTGGGTATACTCCGG | CCGGAGTATACCCAGGGGT |
| 2033 | CCCCTGGGTATACTCCGGG | CCCGGAGTATACCCAGGGG |
| 2034 | CCCTGGGTATACTCCGGGG | CCCCGGAGTATACCCAGGG |
| 2035 | CCTGGGTATACTCCGGGGG | CCCCCGGAGTATACCCAGG |
| 2036 | CTGGGTATACTCCGGGGGC | GCCCCCGGAGTATACCCAG |
| 2037 | TGGGTATACTCCGGGGGCC | GGCCCCCGGAGTATACCCA |
| 2038 | GGGTATACTCCGGGGGCCA | TGGCCCCCGGAGTATACCC |
| 2039 | GGTATACTCCGGGGGCCAG | CTGGCCCCCGGAGTATACC |
| 2040 | GTATACTCCGGGGGCCAGC | GCTGGCCCCCGGAGTATAC |
| 2041 | TATACTCCGGGGGCCAGCC | GGCTGGCCCCCGGAGTATA |
| 2042 | ATACTCCGGGGGCCAGCCC | GGGCTGGCCCCCGGAGTAT |
| 2043 | TACTCCGGGGGCCAGCCCA | TGGGCTGGCCCCCGGAGTA |
| 2044 | ACTCCGGGGGCCAGCCCAA | TTGGGCTGGCCCCCGGAGT |
| 2045 | CTCCGGGGGCCAGCCCAAA | TTTGGGCTGGCCCCCGGAG |
| 2046 | TCCGGGGGCCAGCCCAAAG | CTTTGGGCTGGCCCCCGGA |
| 2047 | CCGGGGGCCAGCCCAAAGT | ACTTTGGGCTGGCCCCCGG |
| 2048 | CGGGGGCCAGCCCAAAGTG | CACTTTGGGCTGGCCCCCG |
| 2049 | GGGGGCCAGCCCAAAGTGC | GCACTTTGGGCTGGCCCCC |
| 2050 | GGGGCCAGCCCAAAGTGCC | GGCACTTTGGGCTGGCCCC |
| 2051 | GGGCCAGCCCAAAGTGCCC | GGGCACTTTGGGCTGGCCC |
| 2052 | GGCCAGCCCAAAGTGCCCT | AGGGCACTTTGGGCTGGCC |
| 2053 | GCCAGCCCAAAGTGCCCTC | GAGGGCACTTTGGGCTGGC |
| 2054 | CCAGCCCAAAGTGCCCTCT | AGAGGGCACTTTGGGCTGG |
| 2055 | CAGCCCAAAGTGCCCTCTG | CAGAGGGCACTTTGGGCTG |
| 2056 | AGCCCAAAGTGCCCTCTGC | GCAGAGGGCACTTTGGGCT |
| 2057 | GCCCAAAGTGCCCTCTGCC | GGCAGAGGGCACTTTGGGC |
| 2058 | CCCAAAGTGCCCTCTGCCT | AGGCAGAGGGCACTTTGGG |
| 2059 | CCAAAGTGCCCTCTGCCTT | AAGGCAGAGGGCACTTTGG |
| 2060 | CAAAGTGCCCTCTGCCTTC | GAAGGCAGAGGGCACTTTG |
| 2061 | AAAGTGCCCTCTGCCTTCA | TGAAGGCAGAGGGCACTTT |
| 2062 | AAGTGCCCTCTGCCTTCAG | CTGAAGGCAGAGGGCACTT |
| 2063 | AGTGCCCTCTGCCTTCAGC | GCTGAAGGCAGAGGGCACT |
| 2064 | GTGCCCTCTGCCTTCAGCT | AGCTGAAGGCAGAGGGCAC |
| 2065 | TGCCCTCTGCCTTCAGCTT | AAGCTGAAGGCAGAGGGCA |
| 2066 | GCCCTCTGCCTTCAGCTTA | TAAGCTGAAGGCAGAGGGC |
| 2067 | CCCTCTGCCTTCAGCTTAG | CTAAGCTGAAGGCAGAGGG |
| 2068 | CCTCTGCCTTCAGCTTAGG | CCTAAGCTGAAGGCAGAGG |
| 2069 | CTCTGCCTTCAGCTTAGGC | GCCTAAGCTGAAGGCAGAG |
| 2070 | TCTGCCTTCAGCTTAGGCA | TGCCTAAGCTGAAGGCAGA |
| 2071 | CTGCCTTCAGCTTAGGCAG | CTGCCTAAGCTGAAGGCAG |
| 2072 | TGCCTTCAGCTTAGGCAGC | GCTGCCTAAGCTGAAGGCA |
| 2073 | GCCTTCAGCTTAGGCAGCA | TGCTGCCTAAGCTGAAGGC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X – 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2074 | CCTTCAGCTTAGGCAGCAA | TTGCTGCCTAAGCTGAAGG |
| 2075 | CTTCAGCTTAGGCAGCAAG | CTTGCTGCCTAAGCTGAAG |
| 2076 | TTCAGCTTAGGCAGCAAGG | CCTTGCTGCCTAAGCTGAA |
| 2077 | TCAGCTTAGGCAGCAAGGG | CCCTTGCTGCCTAAGCTGA |
| 2078 | CAGCTTAGGCAGCAAGGGC | GCCCTTGCTGCCTAAGCTG |
| 2079 | AGCTTAGGCAGCAAGGGCT | AGCCCTTGCTGCCTAAGCT |
| 2080 | GCTTAGGCAGCAAGGGCTT | AAGCCCTTGCTGCCTAAGC |
| 2081 | CTTAGGCAGCAAGGGCTTT | AAAGCCCTTGCTGCCTAAG |
| 2082 | TTAGGCAGCAAGGGCTTTT | AAAAGCCCTTGCTGCCTAA |
| 2083 | TAGGCAGCAAGGGCTTTTA | TAAAAGCCCTTGCTGCCTA |
| 2084 | AGGCAGCAAGGGCTTTTAC | GTAAAAGCCCTTGCTGCCT |
| 2085 | GGCAGCAAGGGCTTTTACT | AGTAAAAGCCCTTGCTGCC |
| 2086 | GCAGCAAGGGCTTTTACTA | TAGTAAAAGCCCTTGCTGC |
| 2087 | CAGCAAGGGCTTTTACTAC | GTAGTAAAAGCCCTTGCTG |
| 2088 | AGCAAGGGCTTTTACTACA | TGTAGTAAAAGCCCTTGCT |
| 2089 | GCAAGGGCTTTTACTACAA | TTGTAGTAAAAGCCCTTGC |
| 2090 | CAAGGGCTTTTACTACAAG | CTTGTAGTAAAAGCCCTTG |
| 2091 | AAGGGCTTTTACTACAAGG | CCTTGTAGTAAAAGCCCTT |
| 2092 | AGGGCTTTTACTACAAGGA | TCCTTGTAGTAAAAGCCCT |
| 2093 | GGGCTTTTACTACAAGGAT | ATCCTTGTAGTAAAAGCCC |
| 2094 | GGCTTTTACTACAAGGATC | GATCCTTGTAGTAAAAGCC |
| 2095 | GCTTTTACTACAAGGATCC | GGATCCTTGTAGTAAAAGC |
| 2096 | CTTTTACTACAAGGATCCG | CGGATCCTTGTAGTAAAAG |
| 2097 | TTTTACTACAAGGATCCGA | TCGGATCCTTGTAGTAAAA |
| 2098 | TTTACTACAAGGATCCGAG | CTCGGATCCTTGTAGTAAA |
| 2099 | TTACTACAAGGATCCGAGC | GCTCGGATCCTTGTAGTAA |
| 2100 | TACTACAAGGATCCGAGCA | TGCTCGGATCCTTGTAGTA |
| 2101 | ACTACAAGGATCCGAGCAT | ATGCTCGGATCCTTGTAGT |
| 2102 | CTACAAGGATCCGAGCATT | AATGCTCGGATCCTTGTAG |
| 2103 | TACAAGGATCCGAGCATTC | GAATGCTCGGATCCTTGTA |
| 2104 | ACAAGGATCCGAGCATTCC | GGAATGCTCGGATCCTTGT |
| 2105 | CAAGGATCCGAGCATTCCC | GGGAATGCTCGGATCCTTG |
| 2106 | AAGGATCCGAGCATTCCCA | TGGGAATGCTCGGATCCTT |
| 2107 | AGGATCCGAGCATTCCCAG | CTGGGAATGCTCGGATCCT |
| 2108 | GGATCCGAGCATTCCCAGG | CCTGGGAATGCTCGGATCC |
| 2109 | GATCCGAGCATTCCCAGGT | ACCTGGGAATGCTCGGATC |
| 2110 | ATCCGAGCATTCCCAGGTT | AACCTGGGAATGCTCGGAT |
| 2111 | TCCGAGCATTCCCAGGTTG | CAACCTGGGAATGCTCGGA |
| 2112 | CCGAGCATTCCCAGGTTGG | CCAACCTGGGAATGCTCGG |
| 2113 | CGAGCATTCCCAGGTTGGC | GCCAACCTGGGAATGCTCG |
| 2114 | GAGCATTCCCAGGTTGGCA | TGCCAACCTGGGAATGCTC |
| 2115 | AGCATTCCCAGGTTGGCAA | TTGCCAACCTGGGAATGCT |
| 2116 | GCATTCCCAGGTTGGCAAA | TTTGCCAACCTGGGAATGC |
| 2117 | CATTCCCAGGTTGGCAAAG | CTTTGCCAACCTGGGAATG |
| 2118 | ATTCCCAGGTTGGCAAAGG | CCTTTGCCAACCTGGGAAT |
| 2119 | TTCCCAGGTTGGCAAAGGA | TCCTTTGCCAACCTGGGAA |
| 2120 | TCCCAGGTTGGCAAAGGAG | CTCCTTTGCCAACCTGGGA |
| 2121 | CCCAGGTTGGCAAAGGAGC | GCTCCTTTGCCAACCTGGG |
| 2122 | CCAGGTTGGCAAAGGAGCC | GGCTCCTTTGCCAACCTGG |
| 2123 | CAGGTTGGCAAAGGAGCCC | GGGCTCCTTTGCCAACCTG |
| 2124 | AGGTTGGCAAAGGAGCCCT | AGGGCTCCTTTGCCAACCT |
| 2125 | GGTTGGCAAAGGAGCCCTT | AAGGGCTCCTTTGCCAACC |
| 2126 | GTTGGCAAAGGAGCCCTTG | CAAGGGCTCCTTTGCCAAC |
| 2127 | TTGGCAAAGGAGCCCTTGG | CCAAGGGCTCCTTTGCCAA |
| 2128 | TGGCAAAGGAGCCCTTGGC | GCCAAGGGCTCCTTTGCCA |
| 2129 | GGCAAAGGAGCCCTTGGCA | TGCCAAGGGCTCCTTTGCC |
| 2130 | GCAAAGGAGCCCTTGGCAG | CTGCCAAGGGCTCCTTTGC |
| 2131 | CAAAGGAGCCCTTGGCAGC | GCTGCCAAGGGCTCCTTTG |
| 2132 | AAAGGAGCCCTTGGCAGCT | AGCTGCCAAGGGCTCCTTT |
| 2133 | AAGGAGCCCTTGGCAGCTG | CAGCTGCCAAGGGCTCCTT |
| 2134 | AGGAGCCCTTGGCAGCTGC | GCAGCTGCCAAGGGCTCCT |
| 2135 | GGAGCCCTTGGCAGCTGCG | CGCAGCTGCCAAGGGCTCC |
| 2136 | GAGCCCTTGGCAGCTGCGG | CCGCAGCTGCCAAGGGCTC |
| 2137 | AGCCCTTGGCAGCTGCGGA | TCCGCAGCTGCCAAGGGCT |
| 2138 | GCCCTTGGCAGCTGCGGAA | TTCCGCAGCTGCCAAGGGC |
| 2139 | CCCTTGGCAGCTGCGGAAC | GTTCCGCAGCTGCCAAGGG |
| 2140 | CCTTGGCAGCTGCGGAACC | GGTTCCGCAGCTGCCAAGG |
| 2141 | CTTGGCAGCTGCGGAACCT | AGGTTCCGCAGCTGCCAAG |
| 2142 | TTGGCAGCTGCGGAACCTG | CAGGTTCCGCAGCTGCCAA |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 2143 | TGGCAGCTGCGGAACCTGG | CCAGGTTCCGCAGCTGCCA |
| 2144 | GGCAGCTGCGGAACCTGGG | CCCAGGTTCCGCAGCTGCC |
| 2145 | GCAGCTGCGGAACCTGGGT | ACCCAGGTTCCGCAGCTGC |
| 2146 | CAGCTGCGGAACCTGGGTT | AACCCAGGTTCCGCAGCTG |
| 2147 | AGCTGCGGAACCTGGGTTG | CAACCCAGGTTCCGCAGCT |
| 2148 | GCTGCGGAACCTGGGTTGT | ACAACCCAGGTTCCGCAGC |
| 2149 | CTGCGGAACCTGGGTTGTT | AACAACCCAGGTTCCGCAG |
| 2150 | TGCGGAACCTGGGTTGTTT | AAACAACCCAGGTTCCGCA |
| 2151 | GCGGAACCTGGGTTGTTTG | CAAACAACCCAGGTTCCGC |
| 2152 | CGGAACCTGGGTTGTTTGG | CCAAACAACCCAGGTTCCG |
| 2153 | GGAACCTGGGTTGTTTGGC | GCCAAACAACCCAGGTTCC |
| 2154 | GAACCTGGGTTGTTTGGCT | AGCCAAACAACCCAGGTTC |
| 2155 | AACCTGGGTTGTTTGGCTT | AAGCCAAACAACCCAGGTT |
| 2156 | ACCTGGGTTGTTTGGCTTA | TAAGCCAAACAACCCAGGT |
| 2157 | CCTGGGTTGTTTGGCTTAA | TTAAGCCAAACAACCCAGG |
| 2158 | CTGGGTTGTTTGGCTTAAA | TTTAAGCCAAACAACCCAG |
| 2159 | TGGGTTGTTTGGCTTAAAC | GTTTAAGCCAAACAACCCA |
| 2160 | GGGTTGTTTGGCTTAAACT | AGTTTAAGCCAAACAACCC |
| 2161 | GGTTGTTTGGCTTAAACTC | GAGTTTAAGCCAAACAACC |
| 2162 | GTTGTTTGGCTTAAACTCT | AGAGTTTAAGCCAAACAAC |
| 2163 | TTGTTTGGCTTAAACTCTG | CAGAGTTTAAGCCAAACAA |
| 2164 | TGTTTGGCTTAAACTCTGG | CCAGAGTTTAAGCCAAACA |
| 2165 | GTTTGGCTTAAACTCTGGT | ACCAGAGTTTAAGCCAAAC |
| 2166 | TTTGGCTTAAACTCTGGTG | CACCAGAGTTTAAGCCAAA |
| 2167 | TTGGCTTAAACTCTGGTGG | CCACCAGAGTTTAAGCCAA |
| 2168 | TGGCTTAAACTCTGGTGGG | CCCACCAGAGTTTAAGCCA |
| 2169 | GGCTTAAACTCTGGTGGGC | GCCCACCAGAGTTTAAGCC |
| 2170 | GCTTAAACTCTGGTGGGCA | TGCCCACCAGAGTTTAAGC |
| 2171 | CTTAAACTCTGGTGGGCAC | GTGCCCACCAGAGTTTAAG |
| 2172 | TTAAACTCTGGTGGGCACC | GGTGCCCACCAGAGTTTAA |
| 2173 | TAAACTCTGGTGGGCACCT | AGGTGCCCACCAGAGTTTA |
| 2174 | AAACTCTGGTGGGCACCTG | CAGGTGCCCACCAGAGTTT |
| 2175 | AACTCTGGTGGGCACCTGC | GCAGGTGCCCACCAGAGTT |
| 2176 | ACTCTGGTGGGCACCTGCA | TGCAGGTGCCCACCAGAGT |
| 2177 | CTCTGGTGGGCACCTGCAG | CTGCAGGTGCCCACCAGAG |
| 2178 | TCTGGTGGGCACCTGCAGA | TCTGCAGGTGCCCACCAGA |
| 2179 | CTGGTGGGCACCTGCAGAG | CTCTGCAGGTGCCCACCAG |
| 2180 | TGGTGGGCACCTGCAGAGA | TCTCTGCAGGTGCCCACCA |
| 2181 | GGTGGGCACCTGCAGAGAG | CTCTCTGCAGGTGCCCACC |
| 2182 | GTGGGCACCTGCAGAGAGC | GCTCTCTGCAGGTGCCCAC |
| 2183 | TGGGCACCTGCAGAGAGCC | GGCTCTCTGCAGGTGCCCA |
| 2184 | GGGCACCTGCAGAGAGCCG | CGGCTCTCTGCAGGTGCCC |
| 2185 | GGCACCTGCAGAGAGCCGG | CCGGCTCTCTGCAGGTGCC |
| 2186 | GCACCTGCAGAGAGCCGGG | CCCGGCTCTCTGCAGGTGC |
| 2187 | CACCTGCAGAGAGCCGGGG | CCCCGGCTCTCTGCAGGTG |
| 2188 | ACCTGCAGAGAGCCGGGGA | TCCCCGGCTCTCTGCAGGT |
| 2189 | CCTGCAGAGAGCCGGGGAG | CTCCCCGGCTCTCTGCAGG |
| 2190 | CTGCAGAGAGCCGGGGAGG | CCTCCCCGGCTCTCTGCAG |
| 2191 | TGCAGAGAGCCGGGGAGGC | GCCTCCCCGGCTCTCTGCA |
| 2192 | GCAGAGAGCCGGGGAGGCC | GGCCTCCCCGGCTCTCTGC |
| 2193 | CAGAGAGCCGGGGAGGCCG | CGGCCTCCCCGGCTCTCTG |
| 2194 | AGAGAGCCGGGGAGGCCGA | TCGGCCTCCCCGGCTCTCT |
| 2195 | GAGAGCCGGGGAGGCCGAA | TTCGGCCTCCCCGGCTCTC |
| 2196 | AGAGCCGGGGAGGCCGAAC | GTTCGGCCTCCCCGGCTCT |
| 2197 | GAGCCGGGGAGGCCGAACG | CGTTCGGCCTCCCCGGCTC |
| 2198 | AGCCGGGGAGGCCGAACGC | GCGTTCGGCCTCCCCGGCT |
| 2199 | GCCGGGGAGGCCGAACGCC | GGCGTTCGGCCTCCCCGGC |
| 2200 | CCGGGGAGGCCGAACGCCC | GGGCGTTCGGCCTCCCCGG |
| 2201 | CGGGGAGGCCGAACGCCCT | AGGGCGTTCGGCCTCCCCG |
| 2202 | GGGGAGGCCGAACGCCCTT | AAGGGCGTTCGGCCTCCCC |
| 2203 | GGGAGGCCGAACGCCCTTC | GAAGGGCGTTCGGCCTCCC |
| 2204 | GGAGGCCGAACGCCCTTCA | TGAAGGGCGTTCGGCCTCC |
| 2205 | GAGGCCGAACGCCCTTCAC | GTGAAGGGCGTTCGGCCTC |
| 2206 | AGGCCGAACGCCCTTCACT | AGTGAAGGGCGTTCGGCCT |
| 2207 | GGCCGAACGCCCTTCACTG | CAGTGAAGGGCGTTCGGCC |
| 2208 | GCCGAACGCCCTTCACTGC | GCAGTGAAGGGCGTTCGGC |
| 2209 | CCGAACGCCCTTCACTGCA | TGCAGTGAAGGGCGTTCGG |
| 2210 | CGAACGCCCTTCACTGCAC | GTGCAGTGAAGGGCGTTCG |
| 2211 | GAACGCCCTTCACTGCACC | GGTGCAGTGAAGGGCGTTC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 2212 | AACGCCCTTCACTGCACCA | TGGTGCAGTGAAGGGCGTT |
| 2213 | ACGCCCTTCACTGCACCAG | CTGGTGCAGTGAAGGGCGT |
| 2214 | CGCCCTTCACTGCACCAGA | TCTGGTGCAGTGAAGGGCG |
| 2215 | GCCCTTCACTGCACCAGAG | CTCTGGTGCAGTGAAGGGC |
| 2216 | CCCTTCACTGCACCAGAGG | CCTCTGGTGCAGTGAAGGG |
| 2217 | CCTTCACTGCACCAGAGGG | CCCTCTGGTGCAGTGAAGG |
| 2218 | CTTCACTGCACCAGAGGGA | TCCCTCTGGTGCAGTGAAG |
| 2219 | TTCACTGCACCAGAGGGAT | ATCCCTCTGGTGCAGTGAA |
| 2220 | TCACTGCACCAGAGGGATG | CATCCCTCTGGTGCAGTGA |
| 2221 | CACTGCACCAGAGGGATGG | CCATCCCTCTGGTGCAGTG |
| 2222 | ACTGCACCAGAGGGATGGA | TCCATCCCTCTGGTGCAGT |
| 2223 | CTGCACCAGAGGGATGGAG | CTCCATCCCTCTGGTGCAG |
| 2224 | TGCACCAGAGGGATGGAGA | TCTCCATCCCTCTGGTGCA |
| 2225 | GCACCAGAGGGATGGAGAG | CTCTCCATCCCTCTGGTGC |
| 2226 | CACCAGAGGGATGGAGAGA | TCTCTCCATCCCTCTGGTG |
| 2227 | ACCAGAGGGATGGAGAGAT | ATCTCTCCATCCCTCTGGT |
| 2228 | CCAGAGGGATGGAGAGATG | CATCTCTCCATCCCTCTGG |
| 2229 | CAGAGGGATGGAGAGATGG | CCATCTCTCCATCCCTCTG |
| 2230 | AGAGGGATGGAGAGATGGG | CCCATCTCTCCATCCCTCT |
| 2231 | GAGGGATGGAGAGATGGGA | TCCCATCTCTCCATCCCTC |
| 2232 | AGGGATGGAGAGATGGGAG | CTCCCATCTCTCCATCCCT |
| 2233 | GGGATGGAGAGATGGGAGC | GCTCCCATCTCTCCATCCC |
| 2234 | GGATGGAGAGATGGGAGCT | AGCTCCCATCTCTCCATCC |
| 2235 | GATGGAGAGATGGGAGCTG | CAGCTCCCATCTCTCCATC |
| 2236 | ATGGAGAGATGGGAGCTGG | CCAGCTCCCATCTCTCCAT |
| 2237 | TGGAGAGATGGGAGCTGGC | GCCAGCTCCCATCTCTCCA |
| 2238 | GGAGAGATGGGAGCTGGCC | GGCCAGCTCCCATCTCTCC |
| 2239 | GAGAGATGGGAGCTGGCCG | CGGCCAGCTCCCATCTCTC |
| 2240 | AGAGATGGGAGCTGGCCGG | CCGGCCAGCTCCCATCTCT |
| 2241 | GAGATGGGAGCTGGCCGGC | GCCGGCCAGCTCCCATCTC |
| 2242 | AGATGGGAGCTGGCCGGCA | TGCCGGCCAGCTCCCATCT |
| 2243 | GATGGGAGCTGGCCGGCAG | CTGCCGGCCAGCTCCCATC |
| 2244 | ATGGGAGCTGGCCGGCAGC | GCTGCCGGCCAGCTCCCAT |
| 2245 | TGGGAGCTGGCCGGCAGCA | TGCTGCCGGCCAGCTCCCA |
| 2246 | GGGAGCTGGCCGGCAGCAG | CTGCTGCCGGCCAGCTCCC |
| 2247 | GGAGCTGGCCGGCAGCAGA | TCTGCTGCCGGCCAGCTCC |
| 2248 | GAGCTGGCCGGCAGCAGAA | TTCTGCTGCCGGCCAGCTC |
| 2249 | AGCTGGCCGGCAGCAGAAT | ATTCTGCTGCCGGCCAGCT |
| 2250 | GCTGGCCGGCAGCAGAATC | GATTCTGCTGCCGGCCAGC |
| 2251 | CTGGCCGGCAGCAGAATCC | GGATTCTGCTGCCGGCCAG |
| 2252 | TGGCCGGCAGCAGAATCCT | AGGATTCTGCTGCCGGCCA |
| 2253 | GGCCGGCAGCAGAATCCTT | AAGGATTCTGCTGCCGGCC |
| 2254 | GCCGGCAGCAGAATCCTTG | CAAGGATTCTGCTGCCGGC |
| 2255 | CCGGCAGCAGAATCCTTGC | GCAAGGATTCTGCTGCCGG |
| 2256 | CGGCAGCAGAATCCTTGCC | GGCAAGGATTCTGCTGCCG |
| 2257 | GGCAGCAGAATCCTTGCCC | GGGCAAGGATTCTGCTGCC |
| 2258 | GCAGCAGAATCCTTGCCCG | CGGGCAAGGATTCTGCTGC |
| 2259 | CAGCAGAATCCTTGCCCGC | GCGGGCAAGGATTCTGCTG |
| 2260 | AGCAGAATCCTTGCCCGCT | AGCGGGCAAGGATTCTGCT |
| 2261 | GCAGAATCCTTGCCCGCTC | GAGCGGGCAAGGATTCTGC |
| 2262 | CAGAATCCTTGCCCGCTCT | AGAGCGGGCAAGGATTCTG |
| 2263 | AGAATCCTTGCCCGCTCTT | AAGAGCGGGCAAGGATTCT |
| 2264 | GAATCCTTGCCCGCTCTTC | GAAGAGCGGGCAAGGATTC |
| 2265 | AATCCTTGCCCGCTCTTCC | GGAAGAGCGGGCAAGGATT |
| 2266 | ATCCTTGCCCGCTCTTCCT | AGGAAGAGCGGGCAAGGAT |
| 2267 | TCCTTGCCCGCTCTTCCTG | CAGGAAGAGCGGGCAAGGA |
| 2268 | CCTTGCCCGCTCTTCCTGG | CCAGGAAGAGCGGGCAAGG |
| 2269 | CTTGCCCGCTCTTCCTGGG | CCCAGGAAGAGCGGGCAAG |
| 2270 | TTGCCCGCTCTTCCTGGGG | CCCCAGGAAGAGCGGGCAA |
| 2271 | TGCCCGCTCTTCCTGGGGC | GCCCCAGGAAGAGCGGGCA |
| 2272 | GCCCGCTCTTCCTGGGGCA | TGCCCCAGGAAGAGCGGGC |
| 2273 | CCCGCTCTTCCTGGGGCAG | CTGCCCCAGGAAGAGCGGG |
| 2274 | CCGCTCTTCCTGGGGCAGC | GCTGCCCCAGGAAGAGCGG |
| 2275 | CGCTCTTCCTGGGGCAGCC | GGCTGCCCCAGGAAGAGCG |
| 2276 | GCTCTTCCTGGGGCAGCCA | TGGCTGCCCCAGGAAGAGC |
| 2277 | CTCTTCCTGGGGCAGCCAG | CTGGCTGCCCCAGGAAGAG |
| 2278 | TCTTCCTGGGGCAGCCAGA | TCTGGCTGCCCCAGGAAGA |
| 2279 | CTTCCTGGGGCAGCCAGAC | GTCTGGCTGCCCCAGGAAG |
| 2280 | TTCCTGGGGCAGCCAGACA | TGTCTGGCTGCCCCAGGAA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2281 | TCCTGGGGCAGCCAGACAC | GTGTCTGGCTGCCCCAGGA |
| 2282 | CCTGGGGCAGCCAGACACT | AGTGTCTGGCTGCCCCAGG |
| 2283 | CTGGGGCAGCCAGACACTG | CAGTGTCTGGCTGCCCCAG |
| 2284 | TGGGGCAGCCAGACACTGT | ACAGTGTCTGGCTGCCCCA |
| 2285 | GGGGCAGCCAGACACTGTG | CACAGTGTCTGGCTGCCCC |
| 2286 | GGGCAGCCAGACACTGTGC | GCACAGTGTCTGGCTGCCC |
| 2287 | GGCAGCCAGACACTGTGCC | GGCACAGTGTCTGGCTGCC |
| 2288 | GCAGCCAGACACTGTGCCC | GGGCACAGTGTCTGGCTGC |
| 2289 | CAGCCAGACACTGTGCCCT | AGGGCACAGTGTCTGGCTG |
| 2290 | AGCCAGACACTGTGCCCTG | CAGGGCACAGTGTCTGGCT |
| 2291 | GCCAGACACTGTGCCCTGG | CCAGGGCACAGTGTCTGGC |
| 2292 | CCAGACACTGTGCCCTGGA | TCCAGGGCACAGTGTCTGG |
| 2293 | CAGACACTGTGCCCTGGAC | GTCCAGGGCACAGTGTCTG |
| 2294 | AGACACTGTGCCCTGGACC | GGTCCAGGGCACAGTGTCT |
| 2295 | GACACTGTGCCCTGGACCT | AGGTCCAGGGCACAGTGTC |
| 2296 | ACACTGTGCCCTGGACCTC | GAGGTCCAGGGCACAGTGT |
| 2297 | CACTGTGCCCTGGACCTCC | GGAGGTCCAGGGCACAGTG |
| 2298 | ACTGTGCCCTGGACCTCCT | AGGAGGTCCAGGGCACAGT |
| 2299 | CTGTGCCCTGGACCTCCTG | CAGGAGGTCCAGGGCACAG |
| 2300 | TGTGCCCTGGACCTCCTGG | CCAGGAGGTCCAGGGCACA |
| 2301 | GTGCCCTGGACCTCCTGGC | GCCAGGAGGTCCAGGGCAC |
| 2302 | TGCCCTGGACCTCCTGGCC | GGCCAGGAGGTCCAGGGCA |
| 2303 | GCCCTGGACCTCCTGGCCC | GGGCCAGGAGGTCCAGGGC |
| 2304 | CCCTGGACCTCCTGGCCCG | CGGGCCAGGAGGTCCAGGG |
| 2305 | CCTGGACCTCCTGGCCCGC | GCGGGCCAGGAGGTCCAGG |
| 2306 | CTGGACCTCCTGGCCCGCT | AGCGGGCCAGGAGGTCCAG |
| 2307 | TGGACCTCCTGGCCCGCTT | AAGCGGGCCAGGAGGTCCA |
| 2308 | GGACCTCCTGGCCCGCTTG | CAAGCGGGCCAGGAGGTCC |
| 2309 | GACCTCCTGGCCCGCTTGT | ACAAGCGGGCCAGGAGGTC |
| 2310 | ACCTCCTGGCCCGCTTGTC | GACAAGCGGGCCAGGAGGT |
| 2311 | CCTCCTGGCCCGCTTGTCC | GGACAAGCGGGCCAGGAGG |
| 2312 | CTCCTGGCCCGCTTGTCCC | GGGACAAGCGGGCCAGGAG |
| 2313 | TCCTGGCCCGCTTGTCCCC | GGGGACAAGCGGGCCAGGA |
| 2314 | CCTGGCCCGCTTGTCCCCC | GGGGGACAAGCGGGCCAGG |
| 2315 | CTGGCCCGCTTGTCCCCCA | TGGGGGACAAGCGGGCCAG |
| 2316 | TGGCCCGCTTGTCCCCCAG | CTGGGGGACAAGCGGGCCA |
| 2317 | GGCCCGCTTGTCCCCCAGG | CCTGGGGGACAAGCGGGCC |
| 2318 | GCCCGCTTGTCCCCCAGGC | GCCTGGGGGACAAGCGGGC |
| 2319 | CCCGCTTGTCCCCCAGGCC | GGCCTGGGGGACAAGCGGG |
| 2320 | CCGCTTGTCCCCCAGGCCT | AGGCCTGGGGGACAAGCGG |
| 2321 | CGCTTGTCCCCCAGGCCTT | AAGGCCTGGGGGACAAGCG |
| 2322 | GCTTGTCCCCCAGGCCTTG | CAAGGCCTGGGGGACAAGC |
| 2323 | CTTGTCCCCCAGGCCTTGT | ACAAGGCCTGGGGGACAAG |
| 2324 | TTGTCCCCCAGGCCTTGTT | AACAAGGCCTGGGGGACAA |
| 2325 | TGTCCCCCAGGCCTTGTTC | GAACAAGGCCTGGGGGACA |
| 2326 | GTCCCCCAGGCCTTGTTCA | TGAACAAGGCCTGGGGGAC |
| 2327 | TCCCCCAGGCCTTGTTCAT | ATGAACAAGGCCTGGGGGA |
| 2328 | CCCCCAGGCCTTGTTCATA | TATGAACAAGGCCTGGGGG |
| 2329 | CCCCAGGCCTTGTTCATAC | GTATGAACAAGGCCTGGGG |
| 2330 | CCCAGGCCTTGTTCATACT | AGTATGAACAAGGCCTGGG |
| 2331 | CCAGGCCTTGTTCATACTC | GAGTATGAACAAGGCCTGG |
| 2332 | CAGGCCTTGTTCATACTCT | AGAGTATGAACAAGGCCTG |
| 2333 | AGGCCTTGTTCATACTCTT | AAGAGTATGAACAAGGCCT |
| 2334 | GGCCTTGTTCATACTCTTG | CAAGAGTATGAACAAGGCC |
| 2335 | GCCTTGTTCATACTCTTGG | CCAAGAGTATGAACAAGGC |
| 2336 | CCTTGTTCATACTCTTGGC | GCCAAGAGTATGAACAAGG |
| 2337 | CTTGTTCATACTCTTGGCA | TGCCAAGAGTATGAACAAG |
| 2338 | TTGTTCATACTCTTGGCAA | TTGCCAAGAGTATGAACAA |
| 2339 | TGTTCATACTCTTGGCAAC | GTTGCCAAGAGTATGAACA |
| 2340 | GTTCATACTCTTGGCAACG | CGTTGCCAAGAGTATGAAC |
| 2341 | TTCATACTCTTGGCAACGT | ACGTTGCCAAGAGTATGAA |
| 2342 | TCATACTCTTGGCAACGTC | GACGTTGCCAAGAGTATGA |
| 2343 | CATACTCTTGGCAACGTCT | AGACGTTGCCAAGAGTATG |
| 2344 | ATACTCTTGGCAACGTCTG | CAGACGTTGCCAAGAGTAT |
| 2345 | TACTCTTGGCAACGTCTGG | CCAGACGTTGCCAAGAGTA |
| 2346 | ACTCTTGGCAACGTCTGGG | CCCAGACGTTGCCAAGAGT |
| 2347 | CTCTTGGCAACGTCTGGGC | GCCCAGACGTTGCCAAGAG |
| 2348 | TCTTGGCAACGTCTGGGCT | AGCCCAGACGTTGCCAAGA |
| 2349 | CTTGGCAACGTCTGGGCTG | CAGCCCAGACGTTGCCAAG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2350 | TTGGCAACGTCTGGGCTGG | CCAGCCCAGACGTTGCCAA |
| 2351 | TGGCAACGTCTGGGCTGGG | CCCAGCCCAGACGTTGCCA |
| 2352 | GGCAACGTCTGGGCTGGGC | GCCCAGCCCAGACGTTGCC |
| 2353 | GCAACGTCTGGGCTGGGCC | GGCCCAGCCCAGACGTTGC |
| 2354 | CAACGTCTGGGCTGGGCCA | TGGCCCAGCCCAGACGTTG |
| 2355 | AACGTCTGGGCTGGGCCAG | CTGGCCCAGCCCAGACGTT |
| 2356 | ACGTCTGGGCTGGGCCAGG | CCTGGCCCAGCCCAGACGT |
| 2357 | CGTCTGGGCTGGGCCAGGC | GCCTGGCCCAGCCCAGACG |
| 2358 | GTCTGGGCTGGGCCAGGCG | CGCCTGGCCCAGCCCAGAC |
| 2359 | TCTGGGCTGGGCCAGGCGA | TCGCCTGGCCCAGCCCAGA |
| 2360 | CTGGGCTGGGCCAGGCGAT | ATCGCCTGGCCCAGCCCAG |
| 2361 | TGGGCTGGGCCAGGCGATG | CATCGCCTGGCCCAGCCCA |
| 2362 | GGGCTGGGCCAGGCGATGG | CCATCGCCTGGCCCAGCCC |
| 2363 | GGCTGGGCCAGGCGATGGG | CCCATCGCCTGGCCCAGCC |
| 2364 | GCTGGGCCAGGCGATGGGA | TCCCATCGCCTGGCCCAGC |
| 2365 | CTGGGCCAGGCGATGGGAA | TTCCCATCGCCTGGCCCAG |
| 2366 | TGGGCCAGGCGATGGGAAC | GTTCCCATCGCCTGGCCCA |
| 2367 | GGGCCAGGCGATGGGAACC | GGTTCCCATCGCCTGGCCC |
| 2368 | GGCCAGGCGATGGGAACCT | AGGTTCCCATCGCCTGGCC |
| 2369 | GCCAGGCGATGGGAACCTT | AAGGTTCCCATCGCCTGGC |
| 2370 | CCAGGCGATGGGAACCTTG | CAAGGTTCCCATCGCCTGG |
| 2371 | CAGGCGATGGGAACCTTGG | CCAAGGTTCCCATCGCCTG |
| 2372 | AGGCGATGGGAACCTTGGG | CCCAAGGTTCCCATCGCCT |
| 2373 | GGCGATGGGAACCTTGGGT | ACCCAAGGTTCCCATCGCC |
| 2374 | GCGATGGGAACCTTGGGTA | TACCCAAGGTTCCCATCGC |
| 2375 | CGATGGGAACCTTGGGTAC | GTACCCAAGGTTCCCATCG |
| 2376 | GATGGGAACCTTGGGTACC | GGTACCCAAGGTTCCCATC |
| 2377 | ATGGGAACCTTGGGTACCA | TGGTACCCAAGGTTCCCAT |
| 2378 | TGGGAACCTTGGGTACCAG | CTGGTACCCAAGGTTCCCA |
| 2379 | GGGAACCTTGGGTACCAGC | GCTGGTACCCAAGGTTCCC |
| 2380 | GGAACCTTGGGTACCAGCT | AGCTGGTACCCAAGGTTCC |
| 2381 | GAACCTTGGGTACCAGCTG | CAGCTGGTACCCAAGGTTC |
| 2382 | AACCTTGGGTACCAGCTGG | CCAGCTGGTACCCAAGGTT |
| 2383 | ACCTTGGGTACCAGCTGGG | CCCAGCTGGTACCCAAGGT |
| 2384 | CCTTGGGTACCAGCTGGGG | CCCCAGCTGGTACCCAAGG |
| 2385 | CTTGGGTACCAGCTGGGGC | GCCCCAGCTGGTACCCAAG |
| 2386 | TTGGGTACCAGCTGGGGCC | GGCCCCAGCTGGTACCCAA |
| 2387 | TGGGTACCAGCTGGGGCCA | TGGCCCCAGCTGGTACCCA |
| 2388 | GGGTACCAGCTGGGGCCAC | GTGGCCCCAGCTGGTACCC |
| 2389 | GGTACCAGCTGGGGCCACC | GGTGGCCCCAGCTGGTACC |
| 2390 | GTACCAGCTGGGGCCACCA | TGGTGGCCCCAGCTGGTAC |
| 2391 | TACCAGCTGGGGCCACCAG | CTGGTGGCCCCAGCTGGTA |
| 2392 | ACCAGCTGGGGCCACCAGC | GCTGGTGGCCCCAGCTGGT |
| 2393 | CCAGCTGGGGCCACCAGCA | TGCTGGTGGCCCCAGCTGG |
| 2394 | CAGCTGGGGCCACCAGCAA | TTGCTGGTGGCCCCAGCTG |
| 2395 | AGCTGGGGCCACCAGCAAC | GTTGCTGGTGGCCCCAGCT |
| 2396 | GCTGGGGCCACCAGCAACA | TGTTGCTGGTGGCCCCAGC |
| 2397 | CTGGGGCCACCAGCAACAC | GTGTTGCTGGTGGCCCCAG |
| 2398 | TGGGGCCACCAGCAACACC | GGTGTTGCTGGTGGCCCCA |
| 2399 | GGGGCCACCAGCAACACCA | TGGTGTTGCTGGTGGCCCC |
| 2400 | GGGCCACCAGCAACACCAA | TTGGTGTTGCTGGTGGCCC |
| 2401 | GGCCACCAGCAACACCAAG | CTTGGTGTTGCTGGTGGCC |
| 2402 | GCCACCAGCAACACCAAGG | CCTTGGTGTTGCTGGTGGC |
| 2403 | CCACCAGCAACACCAAGGT | ACCTTGGTGTTGCTGGTGG |
| 2404 | CACCAGCAACACCAAGGTG | CACCTTGGTGTTGCTGGTG |
| 2405 | ACCAGCAACACCAAGGTGC | GCACCTTGGTGTTGCTGGT |
| 2406 | CCAGCAACACCAAGGTGCC | GGCACCTTGGTGTTGCTGG |
| 2407 | CAGCAACACCAAGGTGCCC | GGGCACCTTGGTGTTGCTG |
| 2408 | AGCAACACCAAGGTGCCCC | GGGGCACCTTGGTGTTGCT |
| 2409 | GCAACACCAAGGTGCCCCT | AGGGGCACCTTGGTGTTGC |
| 2410 | CAACACCAAGGTGCCCCTC | GAGGGGCACCTTGGTGTTG |
| 2411 | AACACCAAGGTGCCCCTCT | AGAGGGGCACCTTGGTGTT |
| 2412 | ACACCAAGGTGCCCCTCTC | GAGAGGGGCACCTTGGTGT |
| 2413 | CACCAAGGTGCCCCTCTCC | GGAGAGGGGCACCTTGGTG |
| 2414 | ACCAAGGTGCCCCTCTCCT | AGGAGAGGGGCACCTTGGT |
| 2415 | CCAAGGTGCCCCTCTCCTG | CAGGAGAGGGGCACCTTGG |
| 2416 | CAAGGTGCCCCTCTCCTGA | TCAGGAGAGGGGCACCTTG |
| 2417 | AAGGTGCCCCTCTCCTGAG | CTCAGGAGAGGGGCACCTT |
| 2418 | AGGTGCCCCTCTCCTGAGC | GCTCAGGAGAGGGGCACCT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2419 | GGTGCCCTCTCCTGAGCC | GGCTCAGGAGAGGGCACC |
| 2420 | GTGCCCTCTCCTGAGCCG | CGGCTCAGGAGAGGGCAC |
| 2421 | TGCCCCTCTCCTGAGCCGC | GCGGCTCAGGAGAGGGCA |
| 2422 | GCCCCTCTCCTGAGCCGCC | GGCGGCTCAGGAGAGGGC |
| 2423 | CCCCTCTCCTGAGCCGCCT | AGGCGGCTCAGGAGAGGG |
| 2424 | CCCTCTCCTGAGCCGCCTG | CAGGCGGCTCAGGAGAGG |
| 2425 | CCTCTCCTGAGCCGCCTGT | ACAGGCGGCTCAGGAGAG |
| 2426 | CTCTCCTGAGCCGCCTGTC | GACAGGCGGCTCAGGAGAG |
| 2427 | TCTCCTGAGCCGCCTGTCA | TGACAGGCGGCTCAGGAGA |
| 2428 | CTCCTGAGCCGCCTGTCAC | GTGACAGGCGGCTCAGGAG |
| 2429 | TCCTGAGCCGCCTGTCACC | GGTGACAGGCGGCTCAGGA |
| 2430 | CCTGAGCCGCCTGTCACCC | GGGTGACAGGCGGCTCAGG |
| 2431 | CTGAGCCGCCTGTCACCCA | TGGGTGACAGGCGGCTCAG |
| 2432 | TGAGCCGCCTGTCACCCAG | CTGGGTGACAGGCGGCTCA |
| 2433 | GAGCCGCCTGTCACCCAGC | GCTGGGTGACAGGCGGCTC |
| 2434 | AGCCGCCTGTCACCCAGCG | CGCTGGGTGACAGGCGGCT |
| 2435 | GCCGCCTGTCACCCAGCGG | CCGCTGGGTGACAGGCGGC |
| 2436 | CCGCCTGTCACCCAGCGGG | CCCGCTGGGTGACAGGCGG |
| 2437 | CGCCTGTCACCCAGCGGGG | CCCCGCTGGGTGACAGGCG |
| 2438 | GCCTGTCACCCAGCGGGGC | GCCCCGCTGGGTGACAGGC |
| 2439 | CCTGTCACCCAGCGGGGCT | AGCCCCGCTGGGTGACAGG |
| 2440 | CTGTCACCCAGCGGGGCTG | CAGCCCCGCTGGGTGACAG |
| 2441 | TGTCACCCAGCGGGGCTGC | GCAGCCCCGCTGGGTGACA |
| 2442 | GTCACCCAGCGGGGCTGCT | AGCAGCCCCGCTGGGTGAC |
| 2443 | TCACCCAGCGGGGCTGCTG | CAGCAGCCCCGCTGGGTGA |
| 2444 | CACCCAGCGGGGCTGCTGT | ACAGCAGCCCCGCTGGGTG |
| 2445 | ACCCAGCGGGGCTGCTGTT | AACAGCAGCCCCGCTGGGT |
| 2446 | CCCAGCGGGGCTGCTGTTC | GAACAGCAGCCCCGCTGGG |
| 2447 | CCAGCGGGGCTGCTGTTCA | TGAACAGCAGCCCCGCTGG |
| 2448 | CAGCGGGGCTGCTGTTCAT | ATGAACAGCAGCCCCGCTG |
| 2449 | AGCGGGGCTGCTGTTCATC | GATGAACAGCAGCCCCGCT |
| 2450 | GCGGGGCTGCTGTTCATCC | GGATGAACAGCAGCCCCGC |
| 2451 | CGGGGCTGCTGTTCATCCT | AGGATGAACAGCAGCCCCG |
| 2452 | GGGGCTGCTGTTCATCCTA | TAGGATGAACAGCAGCCCC |
| 2453 | GGGCTGCTGTTCATCCTAC | GTAGGATGAACAGCAGCCC |
| 2454 | GGCTGCTGTTCATCCTACC | GGTAGGATGAACAGCAGCC |
| 2455 | GCTGCTGTTCATCCTACCC | GGGTAGGATGAACAGCAGC |
| 2456 | CTGCTGTTCATCCTACCCA | TGGGTAGGATGAACAGCAG |
| 2457 | TGCTGTTCATCCTACCCAC | GTGGGTAGGATGAACAGCA |
| 2458 | GCTGTTCATCCTACCCACC | GGTGGGTAGGATGAACAGC |
| 2459 | CTGTTCATCCTACCCACCC | GGGTCGGTAGGATGAACAG |
| 2460 | TGTTCATCCTACCCACCCA | TGGGTGGGTAGGATGAACA |
| 2461 | GTTCATCCTACCCACCCAC | GTGGGTGGGTAGGATGAAC |
| 2462 | TTCATCCTACCCACCCACT | AGTGGGTGGGTAGGATGAA |
| 2463 | TCATCCTACCCACCCACTA | TAGTGGGTGGGTAGGATGA |
| 2464 | CATCCTACCCACCCACTAA | TTAGTGGGTGGGTAGGATG |
| 2465 | ATCCTACCCACCCACTAAA | TTTAGTGGGTGGGTAGGAT |
| 2466 | TCCTACCCACCCACTAAAG | CTTTAGTGGGTGGGTAGGA |
| 2467 | CCTACCCACCCACTAAAGG | CCTTTAGTGGGTGGGTAGG |
| 2468 | CTACCCACCCACTAAAGGT | ACCTTTAGTGGGTGGGTAG |
| 2469 | TACCCACCCACTAAAGGTG | CACCTTTAGTGGGTGGGTA |
| 2470 | ACCCACCCACTAAAGGTGG | CCACCTTTAGTGGGTGGGT |
| 2471 | CCCACCCACTAAAGGTGGG | CCCACCTTTAGTGGGTGGG |
| 2472 | CCACCCACTAAAGGTGGGG | CCCCACCTTTAGTGGGTGG |
| 2473 | CACCCACTAAAGGTGGGGG | CCCCCACCTTTAGTGGGTG |
| 2474 | ACCCACTAAAGGTGGGGGT | ACCCCCACCTTTAGTGGGT |
| 2475 | CCCACTAAAGGTGGGGGTC | GACCCCCACCTTTAGTGGG |
| 2476 | CCACTAAAGGTGGGGGTCT | AGACCCCCACCTTTAGTGG |
| 2477 | CACTAAAGGTGGGGGTCTT | AAGACCCCCACCTTTAGTG |
| 2478 | ACTAAAGGTGGGGGTCTTG | CAAGACCCCCACCTTTAGT |
| 2479 | CTAAAGGTGGGGGTCTTGG | CCAAGACCCCCACCTTTAG |
| 2480 | TAAAGGTGGGGGTCTTGGC | GCCAAGACCCCCACCTTTA |
| 2481 | AAAGGTGGGGGTCTTGGCC | GGCCAAGACCCCCACCTTT |
| 2482 | AAGGTGGGGGTCTTGGCCC | GGGCCAAGACCCCCACCTT |
| 2483 | AGGTGGGGGTCTTGGCCCT | AGGGCCAAGACCCCCACCT |
| 2484 | GGTGGGGGTCTTGGCCCTT | AAGGGCCAAGACCCCCACC |
| 2485 | GTGGGGGTCTTGGCCCTTG | CAAGGGCCAAGACCCCCAC |
| 2486 | TGGGGGTCTTGGCCCTTGT | ACAAGGGCCAAGACCCCCA |
| 2487 | GGGGGTCTTGGCCCTTGTG | CACAAGGGCCAAGACCCCC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2488 | GGGGTCTTGGCCCTTGTGG | CCACAAGGGCCAAGACCCC |
| 2489 | GGGTCTTGGCCCTTGTGGG | CCCACAAGGGCCAAGACCC |
| 2490 | GGTCTTGGCCCTTGTGGGA | TCCCACAAGGGCCAAGACC |
| 2491 | GTCTTGGCCCTTGTGGGAA | TTCCCACAAGGGCCAAGAC |
| 2492 | TCTTGGCCCTTGTGGGAAG | CTTCCCACAAGGGCCAAGA |
| 2493 | CTTGGCCCTTGTGGGAAGT | ACTTCCCACAAGGGCCAAG |
| 2494 | TTGGCCCTTGTGGGAAGTG | CACTTCCCACAAGGGCCAA |
| 2495 | TGGCCCTTGTGGGAAGTGC | GCACTTCCCACAAGGGCCA |
| 2496 | GGCCCTTGTGGGAAGTGCC | GGCACTTCCCACAAGGGCC |
| 2497 | GCCCTTGTGGGAAGTGCCA | TGGCACTTCCCACAAGGGC |
| 2498 | CCCTTGTGGGAAGTGCCAG | CTGGCACTTCCCACAAGGG |
| 2499 | CCTTGTGGGAAGTGCCAGG | CCTGGCACTTCCCACAAGG |
| 2500 | CTTGTGGGAAGTGCCAGGA | TCCTGGCACTTCCCACAAG |
| 2501 | TTGTGGGAAGTGCCAGGAG | CTCCTGGCACTTCCCACAA |
| 2502 | TGTGGGAAGTGCCAGGAGG | CCTCCTGGCACTTCCCACA |
| 2503 | GTGGGAAGTGCCAGGAGGG | CCCTCCTGGCACTTCCCAC |
| 2504 | TGGGAAGTGCCAGGAGGGC | GCCCTCCTGGCACTTCCCA |
| 2505 | GGGAAGTGCCAGGAGGGCC | GGCCCTCCTGGCACTTCCC |
| 2506 | GGAAGTGCCAGGAGGGCCT | AGGCCCTCCTGGCACTTCC |
| 2507 | GAAGTGCCAGGAGGGCCTG | CAGGCCCTCCTGGCACTTC |
| 2508 | AAGTGCCAGGAGGGCCTGG | CCAGGCCCTCCTGGCACTT |
| 2509 | AGTGCCAGGAGGGCCTGGA | TCCAGGCCCTCCTGGCACT |
| 2510 | GTGCCAGGAGGGCCTGGAG | CTCCAGGCCCTCCTGGCAC |
| 2511 | TGCCAGGAGGGCCTGGAGG | CCTCCAGGCCCTCCTGGCA |
| 2512 | GCCAGGAGGGCCTGGAGGG | CCCTCCAGGCCCTCCTGGC |
| 2513 | CCAGGAGGGCCTGGAGGGG | CCCCTCCAGGCCCTCCTGG |
| 2514 | CAGGAGGGCCTGGAGGGGG | CCCCCTCCAGGCCCTCCTG |
| 2515 | AGGAGGGCCTGGAGGGGGG | CCCCCCTCCAGGCCCTCCT |
| 2516 | GGAGGGCCTGGAGGGGGGT | ACCCCCCTCCAGGCCCTCC |
| 2517 | GAGGGCCTGGAGGGGGGTG | CACCCCCCTCCAGGCCCTC |
| 2518 | AGGGCCTGGAGGGGGGTGC | GCACCCCCCTCCAGGCCCT |
| 2519 | GGGCCTGGAGGGGGGTGCC | GGCACCCCCCTCCAGGCCC |
| 2520 | GGCCTGGAGGGGGGTGCCA | TGGCACCCCCCTCCAGGCC |
| 2521 | GCCTGGAGGGGGGTGCCAG | CTGGCACCCCCCTCCAGGC |
| 2522 | CCTGGAGGGGGGTGCCAGT | ACTGGCACCCCCCTCCAGG |
| 2523 | CTGGAGGGGGGTGCCAGTG | CACTGGCACCCCCCTCCAG |
| 2524 | TGGAGGGGGGTGCCAGTGG | CCACTGGCACCCCCCTCCA |
| 2525 | GGAGGGGGGTGCCAGTGGA | TCCACTGGCACCCCCCTCC |
| 2526 | GAGGGGGGTGCCAGTGGAG | CTCCACTGGCACCCCCCTC |
| 2527 | AGGGGGGTGCCAGTGGAGC | GCTCCACTGGCACCCCCCT |
| 2528 | GGGGGGTGCCAGTGGAGCC | GGCTCCACTGGCACCCCCC |
| 2529 | GGGGGTGCCAGTGGAGCCA | TGGCTCCACTGGCACCCCC |
| 2530 | GGGGTGCCAGTGGAGCCAG | CTGGCTCCACTGGCACCCC |
| 2531 | GGGTGCCAGTGGAGCCAGC | GCTGGCTCCACTGGCACCC |
| 2532 | GGTGCCAGTGGAGCCAGCG | CGCTGGCTCCACTGGCACC |
| 2533 | GTGCCAGTGGAGCCAGCGA | TCGCTGGCTCCACTGGCAC |
| 2534 | TGCCAGTGGAGCCAGCGAA | TTCGCTGGCTCCACTGGCA |
| 2535 | GCCAGTGGAGCCAGCGAAC | GTTCGCTGGCTCCACTGGC |
| 2536 | CCAGTGGAGCCAGCGAACC | GGTTCGCTGGCTCCACTGG |
| 2537 | CAGTGGAGCCAGCGAACCC | GGGTTCGCTGGCTCCACTG |
| 2538 | AGTGGAGCCAGCGAACCCA | TGGGTTCGCTGGCTCCACT |
| 2539 | GTGGAGCCAGCGAACCCAG | CTGGGTTCGCTGGCTCCAC |
| 2540 | TGGAGCCAGCGAACCCAGC | GCTGGGTTCGCTGGCTCCA |
| 2541 | GGAGCCAGCGAACCCAGCG | CGCTGGGTTCGCTGGCTCC |
| 2542 | GAGCCAGCGAACCCAGCGA | TCGCTGGGTTCGCTGGCTC |
| 2543 | AGCCAGCGAACCCAGCGAG | CTCGCTGGGTTCGCTGGCT |
| 2544 | GCCAGCGAACCCAGCGAGG | CCTCGCTGGGTTCGCTGGC |
| 2545 | CCAGCGAACCCAGCGAGGA | TCCTCGCTGGGTTCGCTGG |
| 2546 | CAGCGAACCCAGCGAGGAA | TTCCTCGCTGGGTTCGCTG |
| 2547 | AGCGAACCCAGCGAGGAAG | CTTCCTCGCTGGGTTCGCT |
| 2548 | GCGAACCCAGCGAGGAAGT | ACTTCCTCGCTGGGTTCGC |
| 2549 | CGAACCCAGCGAGGAAGTG | CACTTCCTCGCTGGGTTCG |
| 2550 | GAACCCAGCGAGGAAGTGA | TCACTTCCTCGCTGGGTTC |
| 2551 | AACCCAGCGAGGAAGTGAA | TTCACTTCCTCGCTGGGTT |
| 2552 | ACCCAGCGAGGAAGTGAAC | GTTCACTTCCTCGCTGGGT |
| 2553 | CCCAGCGAGGAAGTGAACA | TGTTCACTTCCTCGCTGGG |
| 2554 | CCAGCGAGGAAGTGAACAA | TTGTTCACTTCCTCGCTGG |
| 2555 | CAGCGAGGAAGTGAACAAG | CTTGTTCACTTCCTCGCTG |
| 2556 | AGCGAGGAAGTGAACAAGG | CCTTGTTCACTTCCTCGCT |

TABLE 1-continued cDNA Human Hairless 19-mer Target Sequences and Complement Referenced to NM_005144-
*Homo sapiens* hairless homolog (mouse) (HR), transcript variant 1, complete mRNA (1-5699 bp).
(SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 2557 | GCGAGGAAGTGAACAAGGC | GCCTTGTTCACTTCCTCGC |
| 2558 | CGAGGAAGTGAACAAGGCC | GGCCTTGTTCACTTCCTCG |
| 2559 | GAGGAAGTGAACAAGGCCT | AGGCCTTGTTCACTTCCTC |
| 2560 | AGGAAGTGAACAAGGCCTC | GAGGCCTTGTTCACTTCCT |
| 2561 | GGAAGTGAACAAGGCCTCT | AGAGGCCTTGTTCACTTCC |
| 2562 | GAAGTGAACAAGGCCTCTG | CAGAGGCCTTGTTCACTTC |
| 2563 | AAGTGAACAAGGCCTCTGG | CCAGAGGCCTTGTTCACTT |
| 2564 | AGTGAACAAGGCCTCTGGC | GCCAGAGGCCTTGTTCACT |
| 2565 | GTGAACAAGGCCTCTGGCC | GGCCAGAGGCCTTGTTCAC |
| 2566 | TGAACAAGGCCTCTGGCCC | GGGCCAGAGGCCTTGTTCA |
| 2567 | GAACAAGGCCTCTGGCCCC | GGGGCCAGAGGCCTTGTTC |
| 2568 | AACAAGGCCTCTGGCCCCA | TGGGGCCAGAGGCCTTGTT |
| 2569 | ACAAGGCCTCTGGCCCCAG | CTGGGGCCAGAGGCCTTGT |
| 2570 | CAAGGCCTCTGGCCCCAGG | CCTGGGGCCAGAGGCCTTG |
| 2571 | AAGGCCTCTGGCCCCAGGG | CCCTGGGGCCAGAGGCCTT |
| 2572 | AGGCCTCTGGCCCCAGGGC | GCCCTGGGGCCAGAGGCCT |
| 2573 | GGCCTCTGGCCCCAGGGCC | GGCCCTGGGGCCAGAGGCC |
| 2574 | GCCTCTGGCCCCAGGGCCT | AGGCCCTGGGGCCAGAGGC |
| 2575 | CCTCTGGCCCCAGGGCCTG | CAGGCCCTGGGGCCAGAGG |
| 2576 | CTCTGGCCCCAGGGCCTGT | ACAGGCCCTGGGGCCAGAG |
| 2577 | TCTGGCCCCAGGGCCTGTC | GACAGGCCCTGGGGCCAGA |
| 2578 | CTGGCCCCAGGGCCTGTCC | GGACAGGCCCTGGGGCCAG |
| 2579 | TGGCCCCAGGGCCTGTCCC | GGGACAGGCCCTGGGGCCA |
| 2580 | GGCCCCAGGGCCTGTCCCC | GGGGACAGGCCCTGGGGCC |
| 2581 | GCCCCAGGGCCTGTCCCCC | GGGGGACAGGCCCTGGGGC |
| 2582 | CCCCAGGGCCTGTCCCCCC | GGGGGGACAGGCCCTGGGG |
| 2583 | CCCAGGGCCTGTCCCCCCA | TGGGGGGACAGGCCCTGGG |
| 2584 | CCAGGGCCTGTCCCCCCAG | CTGGGGGGACAGGCCCTGG |
| 2585 | CAGGGCCTGTCCCCCCAGC | GCTGGGGGGACAGGCCCTG |
| 2586 | AGGGCCTGTCCCCCCAGCC | GGCTGGGGGGACAGGCCCT |
| 2587 | GGGCCTGTCCGCCCAGCCA | TGGCTGGGGGACAGGCCC |
| 2588 | GGCCTGTCCCCCCAGCCAC | GTGGCTGGGGGGACAGGCC |
| 2589 | GCCTGTCCCCCCAGCCACC | GGTGGCTGGGGGGACAGGC |
| 2590 | CCTGTCCCCCCAGCCACCA | TGGTGGCTGGGGGGACAGG |
| 2591 | CTGTCCCCCCAGCGACCAC | GTGGTGGCTGGGGGGACAG |
| 2592 | TGTCCCCCCAGCCACCACA | TGTGGTGGCTGGGGGGACA |
| 2593 | GTCCCCCCAGCCACCACAC | GTGTGGTGGCTGGGGGGAC |
| 2594 | TCCCCCCAGCCACCACACC | GGTGTGGTGGCTGGGGGGA |
| 2595 | CCCCCCAGCCACCACACCA | TGGTGTGGTGGCTGGGGGG |
| 2596 | CCCCCAGCCACCACACCAA | TTGGTGTGGTGGCTGGGGG |
| 2597 | CCCCAGCCACCACACCAAG | CTTGGTGTGGTGGCTGGGG |
| 2598 | CCCAGCCACCACACCAAGC | GCTTGGTGTGGTGGCTGGG |
| 2599 | CCAGCCACCACACCAAGCT | AGCTTGGTGTGGTGGCTGG |
| 2600 | CAGCCACCACACCAAGCTG | CAGCTTGGTGTGGTGGCTG |
| 2601 | AGCCACCACACCAAGCTGA | TCAGCTTGGTGTGGTGGCT |
| 2602 | GCCACCACACCAAGCTGAA | TTCAGCTTGGTGTGGTGGC |
| 2603 | CCACCACACCAAGCTGAAG | CTTCAGCTTGGTGTGGTGG |
| 2604 | CACCACACCAAGCTGAAGA | TCTTCAGCTTGGTGTGGTG |
| 2605 | ACCACACCAAGCTGAAGAA | TTCTTCAGCTTGGTGTGGT |
| 2606 | CCACACCAAGCTGAAGAAG | CTTCTTCAGCTTGGTGTGG |
| 2607 | CACACCAAGCTGAAGAAGA | TCTTCTTCAGCTTGGTGTG |
| 2608 | ACACCAAGCTGAAGAAGAC | GTCTTCTTCAGCTTGGTGT |
| 2609 | CACCAAGCTGAAGAAGACA | TGTCTTCTTCAGCTTGGTG |
| 2610 | ACCAAGCTGAAGAAGACAT | ATGTCTTCTTCAGCTTGGT |
| 2611 | CCAAGCTGAAGAAGACATG | CATGTCTTCTTCAGCTTGG |
| 2612 | CAAGCTGAAGAAGACATGG | CCATGTCTTCTTCAGCTTG |
| 2613 | AAGCTGAAGAAGACATGGC | GCCATGTCTTCTTCAGCTT |
| 2614 | AGCTGAAGAAGACATGGCT | AGCCATGTCTTCTTCAGCT |
| 2615 | GCTGAAGAAGACATGGCTC | GAGCCATGTCTTCTTCAGC |
| 2616 | CTGAAGAAGACATGGCTCA | TGAGCCATGTCTTCTTCAG |
| 2617 | TGAAGAAGACATGGCTCAC | GTGAGCCATGTCTTCTTCA |
| 2618 | GAAGAAGACATGGCTCACA | TGTGAGCCATGTCTTCTTC |
| 2619 | AAGAAGACATGGCTCACAC | GTGTGAGCCATGTCTTCTT |
| 2620 | AGAAGACATGGCTCACACG | CGTGTGAGCCATGTCTTCT |
| 2621 | GAAGACATGGCTCACACGG | CCGTGTGAGCCATGTCTTC |
| 2622 | AAGACATGGCTCACACGGC | GCCGTGTGAGCCATGTCTT |
| 2623 | AGACATGGCTCACACGGCA | TGCCGTGTGAGCCATGTCT |
| 2624 | GACATGGCTCACACGGCAC | GTGCCGTGTGAGCCATGTC |
| 2625 | ACATGGCTCACACGGCACT | AGTGCCGTGTGAGCCATGT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2626 | CATGGCTCACACGGCACTC | GAGTGCCGTGTGAGCCATG |
| 2627 | ATGGCTCACACGGCACTCG | CGAGTGCCGTGTGAGCCAT |
| 2628 | TGGCTCACACGGCACTCGG | CCGAGTGCCGTGTGAGCCA |
| 2629 | GGCTCACACGGCACTCGGA | TCCGAGTGCCGTGTGAGCC |
| 2630 | GCTCACACGGCACTCGGAG | CTCCGAGTGCCGTGTGAGC |
| 2631 | CTCACACGGCACTCGGAGC | GCTCCGAGTGCCGTGTGAG |
| 2632 | TCACACGGCACTCGGAGCA | TGCTCCGAGTGCCGTGTGA |
| 2633 | CACACGGCACTCGGAGCAG | CTGCTCCGAGTGCCGTGTG |
| 2634 | ACACGGCACTCGGAGCAGT | ACTGCTCCGAGTGCCGTGT |
| 2635 | CACGGCACTCGGAGCAGTT | AACTGCTCCGAGTGCCGTG |
| 2636 | ACGGCACTCGGAGCAGTTT | AAACTGCTCCGAGTGCCGT |
| 2637 | CGGCACTCGGAGCAGTTTG | CAAACTGCTCCGAGTGCCG |
| 2638 | GGCACTCGGAGCAGTTTGA | TCAAACTGCTCCGAGTGCC |
| 2639 | GCACTCGGAGCAGTTTGAA | TTCAAACTGCTCCGAGTGC |
| 2640 | CACTCGGAGCAGTTTGAAT | ATTCAAACTGCTCCGAGTG |
| 2641 | ACTCGGAGCAGTTTGAATG | CATTCAAACTGCTCCGAGT |
| 2642 | CTCGGAGCAGTTTGAATGT | ACATTCAAACTGCTCCGAG |
| 2643 | TCGGAGCAGTTTGAATGTC | GACATTCAAACTGCTCCGA |
| 2644 | CGGAGCAGTTTGAATGTCC | GGACATTCAAACTGCTCCG |
| 2645 | GGAGCAGTTTGAATGTCCA | TGGACATTCAAACTGCTCC |
| 2646 | GAGCAGTTTGAATGTCCAC | GTGGACATTCAAACTGCTC |
| 2647 | AGCAGTTTGAATGTCCACG | CGTGGACATTCAAACTGCT |
| 2648 | GCAGTTTGAATGTCCACGC | GCGTGGACATTCAAACTGC |
| 2649 | CAGTTTGAATGTCCACGCG | CGCGTGGACATTCAAACTG |
| 2650 | AGTTTGAATGTCCACGCGG | CCGCGTGGACATTCAAACT |
| 2651 | GTTTGAATGTCCACGCGGC | GCCGCGTGGACATTCAAAC |
| 2652 | TTTGAATGTCCACGCGGCT | AGCCGCGTGGACATTCAAA |
| 2653 | TTGAATGTCCACGCGGCTG | CAGCCGCGTGGACATTCAA |
| 2654 | TGAATGTCCACGCGGCTGC | GCAGCCGCGTGGACATTCA |
| 2655 | GAATGTCCACGCGGCTGCC | GGCAGCCGCGTGGACATTC |
| 2656 | AATGTCCACGCGGCTGCCC | GGGCAGCCGCGTGGACATT |
| 2657 | ATGTCCACGCGGCTGCCCT | AGGGCAGCCGCGTGGACAT |
| 2658 | TGTCCACGCGGCTGCCCTG | CAGGGCAGCCGCGTGGACA |
| 2659 | GTCCACGCGGCTGCCCTGA | TCAGGGCAGCCGCGTGGAC |
| 2660 | TCCACGCGGCTGCCCTGAG | CTCAGGGCAGCCGCGTGGA |
| 2661 | CCACGCGGCTGCCCTGAGG | CCTCAGGGCAGCCGCGTGG |
| 2662 | CACGCGGCTGCCCTGAGGT | ACCTCAGGGCAGCCGCGTG |
| 2663 | ACGCGGCTGCCCTGAGGTC | GACCTCAGGGCAGCCGCGT |
| 2664 | CGCGGCTGCCCTGAGGTCG | CGACCTCAGGGCAGCCGCG |
| 2665 | GCGGCTGCCCTGAGGTCGA | TCGACCTCAGGGCAGCCGC |
| 2666 | CGGCTGCCCTGAGGTCGAG | CTCGACCTCAGGGCAGCCG |
| 2667 | GGCTGCCCTGAGGTCGAGG | CCTCGACCTCAGGGCAGCC |
| 2668 | GCTGCCCTGAGGTCGAGGA | TCCTCGACCTCAGGGCAGC |
| 2669 | CTGCCCTGAGGTCGAGGAG | CTCCTCGACCTCAGGGCAG |
| 2670 | TGCCCTGAGGTCGAGGAGA | TCTCCTCGACCTCAGGGCA |
| 2671 | GCCCTGAGGTCGAGGAGAG | CTCTCCTCGACCTCAGGGC |
| 2672 | CCCTGAGGTCGAGGAGAGG | CCTCTCCTCGACCTCAGGG |
| 2673 | CCTGAGGTCGAGGAGAGGC | GCCTCTCCTCGACCTCAGG |
| 2674 | CTGAGGTCGAGGAGAGGCC | GGCCTCTCCTCGACCTCAG |
| 2675 | TGAGGTCGAGGAGAGGCCG | CGGCCTCTCCTCGACCTCA |
| 2676 | GAGGTCGAGGAGAGGCCGG | CCGGCCTCTCCTCGACCTC |
| 2677 | AGGTCGAGGAGAGGCCGGT | ACCGGCCTCTCCTCGACCT |
| 2678 | GGTCGAGGAGAGGCCGGTT | AACCGGCCTCTCCTCGACC |
| 2679 | GTCGAGGAGAGGCCGGTTG | CAACCGGCCTCTCCTCGAC |
| 2680 | TCGAGGAGAGGCCGGTTGC | GCAACCGGCCTCTCCTCGA |
| 2681 | CGAGGAGAGGCCGGTTGCT | AGCAACCGGCCTCTCCTCG |
| 2682 | GAGGAGAGGCCGGTTGCTC | GAGCAACCGGCCTCTCCTC |
| 2683 | AGGAGAGGCCGGTTGCTCG | CGAGCAACCGGCCTCTCCT |
| 2684 | GGAGAGGCCGGTTGCTCGG | CCGAGCAACCGGCCTCTCC |
| 2685 | GAGAGGCCGGTTGCTCGGC | GCCGAGCAACCGGCCTCTC |
| 2686 | AGAGGCCGGTTGCTCGGCT | AGCCGAGCAACCGGCCTCT |
| 2687 | GAGGCCGGTTGCTCGGCTC | GAGCCGAGCAACCGGCCTC |
| 2688 | AGGCCGGTTGCTCGGCTCC | GGAGCCGAGCAACCGGCCT |
| 2689 | GGCCGGTTGCTCGGCTCCG | CGGAGCCGAGCAACCGGCC |
| 2690 | GCCGGTTGCTCGGCTCCGG | CCGGAGCCGAGCAACCGGC |
| 2691 | CCGGTTGCTCGGCTCCGGG | CCCGGAGCCGAGCAACCGG |
| 2692 | CGGTTGCTCGGCTCCGGGC | GCCCGGAGCCGAGCAACCG |
| 2693 | GGTTGCTCGGCTCCGGGCC | GGCCCGGAGCCGAGCAACC |
| 2694 | GTTGCTCGGCTCCGGGCCC | GGGCCCGGAGCCGAGCAAC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2695 | TTGCTCGGCTCCGGGCCCT | AGGGCCCGGAGCCGAGCAA |
| 2696 | TGCTCGGCTCCGGGCCCTC | GAGGGCCCGGAGCCGAGCA |
| 2697 | GCTCGGCTCCGGGCCCTCA | TGAGGGCCCGGAGCCGAGC |
| 2698 | CTCGGCTCCGGGCCCTCAA | TTGAGGGCCCGGAGCCGAG |
| 2699 | TCGGCTCCGGGCCCTCAAA | TTTGAGGGCCCGGAGCCGA |
| 2700 | CGGCTCCGGGCCCTCAAAA | TTTTGAGGGCCCGGAGCCG |
| 2701 | GGCTCCGGGCCCTCAAAAG | CTTTTGAGGGCCCGGAGCC |
| 2702 | GCTCCGGGCCCTCAAAAGG | CCTTTTGAGGGCCCGGAGC |
| 2703 | CTCCGGGCCCTCAAAAGGG | CCCTTTTGAGGGCCCGGAG |
| 2704 | TCCGGGCCCTCAAAAGGGC | GCCCTTTTGAGGGCCCGGA |
| 2705 | CCGGGCCCTCAAAAGGGCA | TGCCCTTTTGAGGGCCCGG |
| 2706 | CGGGCCCTCAAAAGGGCAG | CTGCCCTTTTGAGGGCCCG |
| 2707 | GGGCCCTCAAAAGGGCAGG | CCTGCCCTTTTGAGGGCCC |
| 2708 | GGCCCTCAAAAGGGCAGGC | GCCTGCCCTTTTGAGGGCC |
| 2709 | GCCCTCAAAAGGGCAGGCA | TGCCTGCCCTTTTGAGGGC |
| 2710 | CCCTCAAAAGGGCAGGCAG | CTGCCTGCCCTTTTGAGGG |
| 2711 | CCTCAAAAGGGCAGGCAGC | GCTGCCTGCCCTTTTGAGG |
| 2712 | CTCAAAAGGGCAGGCAGCC | GGCTGCCTGCCCTTTTGAG |
| 2713 | TCAAAAGGGCAGGCAGCCC | GGGCTGCCTGCCCTTTTGA |
| 2714 | CAAAAGGGCAGGCAGCCCC | GGGGCTGCCTGCCCTTTTG |
| 2715 | AAAAGGGCAGGCAGCCCCG | CGGGGCTGCCTGCCCTTTT |
| 2716 | AAAGGGCAGGCAGCCCCGA | TCGGGGCTGCCTGCCCTTT |
| 2717 | AAGGGCAGGCAGCCCCGAG | CTCGGGGCTGCCTGCCCTT |
| 2718 | AGGGCAGGCAGCCCCGAGG | CCTCGGGGCTGCCTGCCCT |
| 2719 | GGGCAGGCAGCCCCGAGGT | ACCTCGGGGCTGCCTGCCC |
| 2720 | GGCAGGCAGCCCCGAGGTC | GACCTCGGGGCTGCCTGCC |
| 2721 | GCAGGCAGCCCCGAGGTCC | GGACCTCGGGGCTGCCTGC |
| 2722 | CAGGCAGCCCCGAGGTCCA | TGGACCTCGGGGCTGCCTG |
| 2723 | AGGCAGCCCCGAGGTCCAG | CTGGACCTCGGGGCTGCCT |
| 2724 | GGCAGCCCCGAGGTCCAGG | CCTGGACCTCGGGGCTGCC |
| 2725 | GCAGCCCCGAGGTCCAGGG | CCCTGGACCTCGGGGCTGC |
| 2726 | CAGCCCCGAGGTCCAGGGA | TCCCTGGACCTCGGGGCTG |
| 2727 | AGCCCCGAGGTCCAGGGAG | CTCCCTGGACCTCGGGGCT |
| 2728 | GCCCCGAGGTCCAGGGAGC | GCTCCCTGGACCTCGGGGC |
| 2729 | CCCCGAGGTCCAGGGAGCA | TGCTCCCTGGACCTCGGGG |
| 2730 | CCCGAGGTCCAGGGAGCAA | TTGCTCCCTGGACCTCGGG |
| 2731 | CCGAGGTCCAGGGAGCAAT | ATTGCTCCCTGGACCTCGG |
| 2732 | CGAGGTCCAGGGAGCAATG | CATTGCTCCCTGGACCTCG |
| 2733 | GAGGTCCAGGGAGCAATGG | CCATTGCTCCCTGGACCTC |
| 2734 | AGGTCCAGGGAGCAATGGG | CCCATTGCTCCCTGGACCT |
| 2735 | GGTCCAGGGAGCAATGGGC | GCCCATTGCTCCCTGGACC |
| 2736 | GTCCAGGGAGCAATGGGCA | TGCCCATTGCTCCCTGGAC |
| 2737 | TCCAGGGAGCAATGGGCAG | CTGCCCATTGCTCCCTGGA |
| 2738 | CCAGGGAGCAATGGGCAGT | ACTGCCCATTGCTCCCTGG |
| 2739 | CAGGGAGCAATGGGCAGTC | GACTGCCCATTGCTCCCTG |
| 2740 | AGGGAGCAATGGGCAGTCC | GGACTGCCCATTGCTCCCT |
| 2741 | GGGAGCAATGGGCAGTCCA | TGGACTGCCCATTGCTCCC |
| 2742 | GGAGCAATGGGCAGTCCAG | CTGGACTGCCCATTGCTCC |
| 2743 | GAGCAATGGGCAGTCCAGC | GCTGGACTGCCCATTGCTC |
| 2744 | AGCAATGGGCAGTCCAGCC | GGCTGGACTGCCCATTGCT |
| 2745 | GCAATGGGCAGTCCAGCCC | GGGCTGGACTGCCCATTGC |
| 2746 | CAATGGGCAGTCCAGCCCC | GGGGCTGGACTGCCCATTG |
| 2747 | AATGGGCAGTCCAGCCCCC | GGGGGCTGGACTGCCCATT |
| 2748 | ATGGGCAGTCCAGCCCCCA | TGGGGGCTGGACTGCCCAT |
| 2749 | TGGGCAGTCCAGCCCCCAA | TTGGGGGCTGGACTGCCCA |
| 2750 | GGGCAGTCCAGCCCCCAAG | CTTGGGGGCTGGACTGCCC |
| 2751 | GGCAGTCCAGCCCCCAAGC | GCTTGGGGGCTGGACTGCC |
| 2752 | GCAGTCCAGCCCCCAAGCG | CGCTTGGGGGCTGGACTGC |
| 2753 | CAGTCCAGCCCCCAAGCGG | CCGCTTGGGGGCTGGACTG |
| 2754 | AGTCCAGCCCCCAAGCGGC | GCCGCTTGGGGGCTGGACT |
| 2755 | GTCCAGCCCCCAAGCGGCC | GGCCGCTTGGGGGCTGGAC |
| 2756 | TCCAGCCCCCAAGCGGCCA | TGGCCGCTTGGGGGCTGGA |
| 2757 | CCAGCCCCCAAGCGGCCAC | GTGGCCGCTTGGGGGCTGG |
| 2758 | CAGCCCCCAAGCGGCCACC | GGTGGCCGCTTGGGGGCTG |
| 2759 | AGCCCCCAAGCGGCCACCG | CGGTGGCCGCTTGGGGGCT |
| 2760 | GCCCCCAAGCGGCCACCGG | CCGGTGGCCGCTTGGGGGC |
| 2761 | CCCCCAAGCGGCCACCGGA | TCCGGTGGCCGCTTGGGGG |
| 2762 | CCCCAAGCGGCCACCGGAC | GTCCGGTGGCCGCTTGGGG |
| 2763 | CCCAAGCGGCCACCGGACC | GGTCCGGTGGCCGCTTGGG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2764 | CCAAGCGGCCACCGGACCC | GGGTCCGGTGGCCGCTTGG |
| 2765 | CAAGCGGCCACCGGACCCT | AGGGTCCGGTGGCCGCTTG |
| 2766 | AAGCGGCCACCGGACCCTT | AAGGGTCCGGTGGCCGCTT |
| 2767 | AGCGGCCACCGGACCCTTT | AAAGGGTCCGGTGGCCGCT |
| 2768 | GCGGCCACCGGACCCTTTT | AAAAGGGTCCGGTGGCCGC |
| 2769 | CGGCCACCGGACCCTTTTC | GAAAAGGGTCCGGTGGCCG |
| 2770 | GGCCACCGGACCCTTTTCC | GGAAAAGGGTCCGGTGGCC |
| 2771 | GCCACCGGACCCTTTTCCA | TGGAAAAGGGTCCGGTGGC |
| 2772 | CCACCGGACCCTTTTCCAG | CTGGAAAAGGGTCCGGTGG |
| 2773 | CACCGGACCCTTTTCCAGG | CCTGGAAAAGGGTCCGGTG |
| 2774 | ACCGGACCCTTTTCCAGGC | GCCTGGAAAAGGGTCCGGT |
| 2775 | CCGGACCCTTTTCCAGGCA | TGCCTGGAAAAGGGTCCGG |
| 2776 | CGGACCCTTTTCCAGGCAC | GTGCCTGGAAAAGGGTCCG |
| 2777 | GGACCCTTTTCCAGGCACT | AGTGCCTGGAAAAGGGTCC |
| 2778 | GACCCTTTTCCAGGCACTG | CAGTGCCTGGAAAAGGGTC |
| 2779 | ACCCTTTTCCAGGCACTGC | GCAGTGCCTGGAAAAGGGT |
| 2780 | CCCTTTTCCAGGCACTGCA | TGCAGTGCCTGGAAAAGGG |
| 2781 | CCTTTTCCAGGCACTGCAG | CTGCAGTGCCTGGAAAAGG |
| 2782 | CTTTTCCAGGCACTGCAGA | TCTGCAGTGCCTGGAAAAG |
| 2783 | TTTTCCAGGCACTGCAGAA | TTCTGCAGTGCCTGGAAAA |
| 2784 | TTTCCAGGCACTGCAGAAC | GTTCTGCAGTGCCTGGAAA |
| 2785 | TTCCAGGCACTGCAGAACA | TGTTCTGCAGTGCCTGGAA |
| 2786 | TCCAGGCACTGCAGAACAG | CTGTTCTGCAGTGCCTGGA |
| 2787 | CCAGGCACTGCAGAACAGG | CCTGTTCTGCAGTGCCTGG |
| 2788 | CAGGCACTGCAGAACAGGG | CCCTGTTCTGCAGTGCCTG |
| 2789 | AGGCACTGCAGAACAGGGG | CCCCTGTTCTGCAGTGCCT |
| 2790 | GGCACTGCAGAACAGGGGG | CCCCCTGTTCTGCAGTGCC |
| 2791 | GCACTGCAGAACAGGGGGC | GCCCCCTGTTCTGCAGTGC |
| 2792 | CACTGCAGAACAGGGGGCT | AGCCCCCTGTTCTGCAGTG |
| 2793 | ACTGCAGAACAGGGGGCTG | CAGCCCCCTGTTCTGCAGT |
| 2794 | CTGCAGAACAGGGGGCTGG | CCAGCCCCCTGTTCTGCAG |
| 2795 | TGCAGAACAGGGGGCTGGG | CCCAGCCCCCTGTTCTGCA |
| 2796 | GCAGAACAGGGGGCTGGGG | CCCCAGCCCCCTGTTCTGC |
| 2797 | CAGAACAGGGGGCTGGGGG | CCCCCAGCCCCCTGTTCTG |
| 2798 | AGAACAGGGGGCTGGGGGT | ACCCCCAGCCCCCTGTTCT |
| 2799 | GAACAGGGGGCTGGGGGTT | AACCCCCAGCCCCCTGTTC |
| 2800 | AACAGGGGGCTGGGGGTTG | CAACCCCCAGCCCCCTGTT |
| 2801 | ACAGGGGGCTGGGGGTTGG | CCAACCCCCAGCCCCCTGT |
| 2802 | CAGGGGGCTGGGGGTTGGC | GCCAACCCCCAGCCCCCTG |
| 2803 | AGGGGGCTGGGGGTTGGCA | TGCCAACCCCCAGCCCCCT |
| 2804 | GGGGGCTGGGGGTTGGCAG | CTGCCAACCCCCAGCCCCC |
| 2805 | GGGGCTGGGGGTTGGCAGG | CCTGCCAACCCCCAGCCCC |
| 2806 | GGGCTGGGGGTTGGCAGGA | TCCTGCCAACCCCCAGCCC |
| 2807 | GGCTGGGGGTTGGCAGGAG | CTCCTGCCAACCCCCAGCC |
| 2808 | GCTGGGGGTTGGCAGGAGG | CCTCCTGCCAACCCCCAGC |
| 2809 | CTGGGGGTTGGCAGGAGGT | ACCTCCTGCCAACCCCCAG |
| 2810 | TGGGGGTTGGCAGGAGGTG | CACCTCCTGCCAACCCCCA |
| 2811 | GGGGGTTGGCAGGAGGTGC | GCACCTCCTGCCAACCCCC |
| 2812 | GGGGTTGGCAGGAGGTGCG | CGCACCTCCTGCCAACCCC |
| 2813 | GGGTTGGCAGGAGGTGCGG | CCGCACCTCCTGCCAACCC |
| 2814 | GGTTGGCAGGAGGTGCGGG | CCCGCACCTCCTGCCAACC |
| 2815 | GTTGGCAGGAGGTGCGGGA | TCCCGCACCTCCTGCCAAC |
| 2816 | TTGGCAGGAGGTGCGGGAC | GTCCCGCACCTCCTGCCAA |
| 2817 | TGGCAGGAGGTGCGGGACA | TGTCCCGCACCTCCTGCCA |
| 2818 | GGCAGGAGGTGCGGGACAC | GTGTCCCGCACCTCCTGCC |
| 2819 | GCAGGAGGTGCGGGACACA | TGTGTCCCGCACCTCCTGC |
| 2820 | CAGGAGGTGCGGGACACAT | ATGTGTCCCGCACCTCCTG |
| 2821 | AGGAGGTGCGGGACACATC | GATGTGTCCCGCACCTCCT |
| 2822 | GGAGGTGCGGGACACATCG | CGATGTGTCCCGCACCTCC |
| 2823 | GAGGTGCGGGACACATCGA | TCGATGTGTCCCGCACCTC |
| 2824 | AGGTGCGGGACACATCGAT | ATCGATGTGTCCCGCACCT |
| 2825 | GGTGCGGGACACATCGATA | TATCGATGTGTCCCGCACC |
| 2826 | GTGCGGGACACATCGATAG | CTATCGATGTGTCCCGCAC |
| 2827 | TGCGGGACACATCGATAGG | CCTATCGATGTGTCCCGCA |
| 2828 | GCGGGACACATCGATAGGG | CCCTATCGATGTGTCCCGC |
| 2829 | CGGGACACATCGATAGGGA | TCCCTATCGATGTGTCCCG |
| 2830 | GGGACACATCGATAGGGAA | TTCCCTATCGATGTGTCCC |
| 2831 | GGACACATCGATAGGGAAC | GTTCCCTATCGATGTGTCC |
| 2832 | GACACATCGATAGGGAACA | TGTTCCCTATCGATGTGTC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 2833 | ACACATCGATAGGGAACAA | TTGTTCCCTATCGATGTGT |
| 2834 | CACATCGATAGGGAACAAG | CTTGTTCCCTATCGATGTG |
| 2835 | ACATCGATAGGGAACAAGG | CCTTGTTCCCTATCGATGT |
| 2836 | CATCGATAGGGAACAAGGA | TCCTTGTTCCCTATCGATG |
| 2837 | ATCGATAGGGAACAAGGAT | ATCCTTGTTCCCTATCGAT |
| 2838 | TCGATAGGGAACAAGGATG | CATCCTTGTTCCCTATCGA |
| 2839 | CGATAGGGAACAAGGATGT | ACATCCTTGTTCCCTATCG |
| 2840 | GATAGGGAACAAGGATGTG | CACATCCTTGTTCCCTATC |
| 2841 | ATAGGGAACAAGGATGTGG | CCACATCCTTGTTCCCTAT |
| 2842 | TAGGGAACAAGGATGTGGA | TCCACATCCTTGTTCCCTA |
| 2843 | AGGGAACAAGGATGTGGAC | GTCCACATCCTTGTTCCCT |
| 2844 | GGGAACAAGGATGTGGACT | AGTCCACATCCTTGTTCCC |
| 2845 | GGAACAAGGATGTGGACTC | GAGTCCACATCCTTGTTCC |
| 2846 | GAACAAGGATGTGGACTCG | CGAGTCCACATCCTTGTTC |
| 2847 | AACAAGGATGTGGACTCGG | CCGAGTCCACATCCTTGTT |
| 2848 | ACAAGGATGTGGACTCGGG | CCCGAGTCCACATCCTTGT |
| 2849 | CAAGGATGTGGACTCGGGA | TCCCGAGTCCACATCCTTG |
| 2850 | AAGGATGTGGACTCGGGAC | GTCCCGAGTCCACATCCTT |
| 2851 | AGGATGTGGACTCGGGACA | TGTCCCGAGTCCACATCCT |
| 2852 | GGATGTGGACTCGGGACAG | CTGTCCCGAGTCCACATCC |
| 2853 | GATGTGGACTCGGGACAGC | GCTGTCCCGAGTCCACATC |
| 2854 | ATGTGGACTCGGGACAGCA | TGCTGTCCCGAGTCCACAT |
| 2855 | TGTGGACTCGGGACAGCAT | ATGCTGTCCCGAGTCCACA |
| 2856 | GTGGACTCGGGACAGCATG | CATGCTGTCCCGAGTCCAC |
| 2857 | TGGACTCGGGACAGCATGA | TCATGCTGTCCCGAGTCCA |
| 2858 | GGACTCGGGACAGCATGAT | ATCATGCTGTCCCGAGTCC |
| 2859 | GACTCGGGACAGCATGATG | CATCATGCTGTCCCGAGTC |
| 2860 | ACTCGGGACAGCATGATGA | TCATCATGCTGTCCCGAGT |
| 2861 | CTCGGGACAGCATGATGAG | CTCATCATGCTGTCCCGAG |
| 2862 | TCGGGACAGCATGATGAGC | GCTCATCATGCTGTCCCGA |
| 2863 | CGGGACAGCATGATGAGCA | TGCTCATCATGCTGTCCCG |
| 2864 | GGGACAGCATGATGAGCAG | CTGCTCATCATGCTGTCCC |
| 2865 | GGACAGCATGATGAGCAGA | TCTGCTCATCATGCTGTCC |
| 2866 | GACAGCATGATGAGCAGAA | TTCTGCTCATCATGCTGTC |
| 2867 | ACAGCATGATGAGCAGAAA | TTTCTGCTCATCATGCTGT |
| 2868 | CAGCATGATGAGCAGAAAG | CTTTCTGCTCATCATGCTG |
| 2869 | AGCATGATGAGCAGAAAGG | CCTTTCTGCTCATCATGCT |
| 2870 | GCATGATGAGCAGAAAGGA | TCCTTTCTGCTCATCATGC |
| 2871 | CATGATGAGCAGAAAGGAC | GTCCTTTCTGCTCATCATG |
| 2872 | ATGATGAGCAGAAAGGACC | GGTCCTTTCTGCTCATCAT |
| 2873 | TGATGAGCAGAAAGGACCC | GGGTCCTTTCTGCTCATCA |
| 2874 | GATGAGCAGAAAGGACCCC | GGGGTCCTTTCTGCTCATC |
| 2875 | ATGAGCAGAAAGGACCCCA | TGGGGTCCTTTCTGCTCAT |
| 2876 | TGAGCAGAAAGGACCCCAA | TTGGGGTCCTTTCTGCTCA |
| 2877 | GAGCAGAAAGGACCCCAAG | CTTGGGGTCCTTTCTGCTC |
| 2878 | AGCAGAAAGGACCCCAAGA | TCTTGGGGTCCTTTCTGCT |
| 2879 | GCAGAAAGGACCCCAAGAT | ATCTTGGGGTCCTTTCTGC |
| 2880 | CAGAAAGGACCCCAAGATG | CATCTTGGGGTCCTTTCTG |
| 2881 | AGAAAGGACCCCAAGATGG | CCATCTTGGGGTCCTTTCT |
| 2882 | GAAAGGACCCCAAGATGGC | GCCATCTTGGGGTCCTTTC |
| 2883 | AAAGGACCCCAAGATGGCC | GGCCATCTTGGGGTCCTTT |
| 2884 | AAGGACCCCAAGATGGCCA | TGGCCATCTTGGGGTCCTT |
| 2885 | AGGACCCCAAGATGGCCAG | CTGGCCATCTTGGGGTCCT |
| 2886 | GGACCCCAAGATGGCCAGG | CCTGGCCATCTTGGGGTCC |
| 2887 | GACCCCAAGATGGCCAGGC | GCCTGGCCATCTTGGGGTC |
| 2888 | ACCCCAAGATGGCCAGGCC | GGCCTGGCCATCTTGGGGT |
| 2889 | CCCCAAGATGGCCAGGCCA | TGGCCTGGCCATCTTGGGG |
| 2890 | CCCAAGATGGCCAGGCCAG | CTGGCCTGGCCATCTTGGG |
| 2891 | CCAAGATGGCCAGGCCAGT | ACTGGCCTGGCCATCTTGG |
| 2892 | CAAGATGGCCAGGCCAGTC | GACTGGCCTGGCCATCTTG |
| 2893 | AAGATGGCCAGGCCAGTCT | AGACTGGCCTGGCCATCTT |
| 2894 | AGATGGCCAGGCCAGTCTC | GAGACTGGCCTGGCCATCT |
| 2895 | GATGGCCAGGCCAGTCTCC | GGAGACTGGCCTGGCCATC |
| 2896 | ATGGCCAGGCCAGTCTCCA | TGGAGACTGGCCTGGCCAT |
| 2897 | TGGCCAGGCCAGTCTCCAG | CTGGAGACTGGCCTGGCCA |
| 2898 | GGCCAGGCCAGTCTCCAGG | CCTGGAGACTGGCCTGGCC |
| 2899 | GCCAGGCCAGTCTCCAGGA | TCCTGGAGACTGGCCTGGC |
| 2900 | CCAGGCCAGTCTCCAGGAC | GTCCTGGAGACTGGCCTGG |
| 2901 | CAGGCCAGTCTCCAGGACC | GGTCCTGGAGACTGGCCTG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 2902 | AGGCCAGTCTCCAGGACCC | GGGTCCTGGAGACTGGCCT |
| 2903 | GGCCAGTCTCCAGGACCCG | CGGGTCCTGGAGACTGGCC |
| 2904 | GCCAGTCTCCAGGACCCGG | CCGGGTCCTGGAGACTGGC |
| 2905 | CCAGTCTCCAGGACCCGGG | CCCGGGTCCTGGAGACTGG |
| 2906 | CAGTCTCCAGGACCCGGGA | TCCCGGGTCCTGGAGACTG |
| 2907 | AGTCTCCAGGACCCGGGAC | GTCCCGGGTCCTGGAGACT |
| 2908 | GTCTCCAGGACCCGGGACT | AGTCCCGGGTCCTGGAGAC |
| 2909 | TCTCCAGGACCCGGGACTT | AAGTCCCGGGTCCTGGAGA |
| 2910 | CTCCAGGACCCGGGACTTC | GAAGTCCCGGGTCCTGGAG |
| 2911 | TCCAGGACCCGGGACTTCA | TGAAGTCCCGGGTCCTGGA |
| 2912 | CCAGGACCCGGGACTTCAG | CTGAAGTCCCGGGTCCTGG |
| 2913 | CAGGACCCGGGACTTCAGG | CCTGAAGTCCCGGGTCCTG |
| 2914 | AGGACCCGGGACTTCAGGA | TCCTGAAGTCCCGGGTCCT |
| 2915 | GGACCCGGGACTTCAGGAC | GTCCTGAAGTCCCGGGTCC |
| 2916 | GACCCGGGACTTCAGGACA | TGTCCTGAAGTCCCGGGTC |
| 2917 | ACCCGGGACTTCAGGACAT | ATGTCCTGAAGTCCCGGGT |
| 2918 | CCCGGGACTTCAGGACATA | TATGTCCTGAAGTCCCGGG |
| 2919 | CCGGGACTTCAGGACATAC | GTATGTCCTGAAGTCCCGG |
| 2920 | CGGGACTTCAGGACATACC | GGTATGTCCTGAAGTCCCG |
| 2921 | GGGACTTCAGGACATACCA | TGGTATGTCCTGAAGTCCC |
| 2922 | GGACTTCAGGACATACCAT | ATGGTATGTCCTGAAGTCC |
| 2923 | GACTTCAGGACATACCATG | CATGGTATGTCCTGAAGTC |
| 2924 | ACTTCAGGACATACCATGC | GCATGGTATGTCCTGAAGT |
| 2925 | CTTCAGGACATACCATGCC | GGCATGGTATGTCCTGAAG |
| 2926 | TTCAGGACATACCATGCCT | AGGCATGGTATGTCCTGAA |
| 2927 | TCAGGACATACCATGCCTG | CAGGCATGGTATGTCCTGA |
| 2928 | CAGGACATACCATGCCTGG | CCAGGCATGGTATGTCCTG |
| 2929 | AGGACATACCATGCCTGGC | GCCAGGCATGGTATGTCCT |
| 2930 | GGACATACCATGCCTGGCT | AGCCAGGCATGGTATGTCC |
| 2931 | GACATACCATGCCTGGCTC | GAGCCAGGCATGGTATGTC |
| 2932 | ACATACCATGCCTGGCTCT | AGAGCCAGGCATGGTATGT |
| 2933 | CATACCATGCCTGGCTCTC | GAGAGCCAGGCATGGTATG |
| 2934 | ATACCATGCCTGGCTCTCC | GGAGAGCCAGGCATGGTAT |
| 2935 | TACCATGCCTGGCTCTCCC | GGGAGAGCCAGGCATGGTA |
| 2936 | ACCATGCCTGGCTCTCCCT | AGGGAGAGCCAGGCATGGT |
| 2937 | CCATGCCTGGCTCTCCCTG | CAGGGAGAGCCAGGCATGG |
| 2938 | CATGCCTGGCTCTCCCTGC | GCAGGGAGAGCCAGGCATG |
| 2939 | ATGCCTGGCTCTCCCTGCA | TGCAGGGAGAGCCAGGCAT |
| 2940 | TGCCTGGCTCTCCCTGCAA | TTGCAGGGAGAGCCAGGCA |
| 2941 | GCCTGGCTCTCCCTGCAAA | TTTGCAGGGAGAGCCAGGC |
| 2942 | CCTGGCTCTCCCTGCAAAA | TTTTGCAGGGAGAGCCAGG |
| 2943 | CTGGCTCTCCCTGCAAAAC | GTTTTGCAGGGAGAGCCAG |
| 2944 | TGGCTCTCCCTGCAAAACT | AGTTTTGCAGGGAGAGCCA |
| 2945 | GGCTCTCCCTGCAAAACTG | CAGTTTTGCAGGGAGAGCC |
| 2946 | GCTCTCCCTGCAAAACTGG | CCAGTTTTGCAGGGAGAGC |
| 2947 | CTCTCCCTGCAAAACTGGC | GCCAGTTTTGCAGGGAGAG |
| 2948 | TCTCCCTGCAAAACTGGCT | AGCCAGTTTTGCAGGGAGA |
| 2949 | CTCCCTGCAAAACTGGCTC | GAGCCAGTTTTGCAGGGAG |
| 2950 | TCCCTGCAAAACTGGCTCA | TGAGCCAGTTTTGCAGGGA |
| 2951 | CCCTGCAAAACTGGCTCAA | TTGAGCCAGTTTTGCAGGG |
| 2952 | CCTGCAAAACTGGCTCAAT | ATTGAGCCAGTTTTGCAGG |
| 2953 | CTGCAAAACTGGCTCAATG | CATTGAGCCAGTTTTGCAG |
| 2954 | TGCAAAACTGGCTCAATGC | GCATTGAGCCAGTTTTGCA |
| 2955 | GCAAAACTGGCTCAATGCC | GGCATTGAGCCAGTTTTGC |
| 2956 | CAAAACTGGCTCAATGCCA | TGGCATTGAGCCAGTTTTG |
| 2957 | AAAACTGGCTCAATGCCAA | TTGGCATTGAGCCAGTTTT |
| 2958 | AAACTGGCTCAATGCCAAA | TTTGGCATTGAGCCAGTTT |
| 2959 | AACTGGCTCAATGCCAAAG | CTTTGGCATTGAGCCAGTT |
| 2960 | ACTGGCTCAATGCCAAAGT | ACTTTGGCATTGAGCCAGT |
| 2961 | CTGGCTCAATGCCAAAGTT | AACTTTGGCATTGAGCCAG |
| 2962 | TGGCTCAATGCCAAAGTTG | CAACTTTGGCATTGAGCCA |
| 2963 | GGCTCAATGCCAAAGTTGT | ACAACTTTGGCATTGAGCC |
| 2964 | GCTCAATGCCAAAGTTGTG | CACAACTTTGGCATTGAGC |
| 2965 | CTCAATGCCAAAGTTGTGC | GCACAACTTTGGCATTGAG |
| 2966 | TCAATGCCAAAGTTGTGCC | GGCACAACTTTGGCATTGA |
| 2967 | CAATGCCAAAGTTGTGCCC | GGGCACAACTTTGGCATTG |
| 2968 | AATGCCAAAGTTGTGCCCA | TGGGCACAACTTTGGCATT |
| 2969 | ATGCCAAAGTTGTGCCCAG | CTGGGCACAACTTTGGCAT |
| 2970 | TGCCAAAGTTGTGCCCAGG | CCTGGGCACAACTTTGGCA |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 2971 | GCCAAAGTTGTGCCCAGGC | GCCTGGGCACAACTTTGGC |
| 2972 | CCAAAGTTGTGCCCAGGCA | TGCCTGGGCACAACTTTGG |
| 2973 | CAAAGTTGTGCCCAGGCAG | CTGCCTGGGCACAACTTTG |
| 2974 | AAAGTTGTGCCCAGGCAGC | GCTGCCTGGGCACAACTTT |
| 2975 | AAGTTGTGCCCAGGCAGCT | AGCTGCCTGGGCACAACTT |
| 2976 | AGTTGTGCCCAGGCAGCTG | CAGCTGCCTGGGCACAACT |
| 2977 | GTTGTGCCCAGGCAGCTGG | CCAGCTGCCTGGGCACAAC |
| 2978 | TTGTGCCCAGGCAGCTGGA | TCCAGCTGCCTGGGCACAA |
| 2979 | TGTGCCCAGGCAGCTGGAG | CTCCAGCTGCCTGGGCACA |
| 2980 | GTGCCCAGGCAGCTGGAGA | TCTCCAGCTGCCTGGGCAC |
| 2981 | TGCCCAGGCAGCTGGAGAG | CTCTCCAGCTGCCTGGGCA |
| 2982 | GCCCAGGCAGCTGGAGAGG | CCTCTCCAGCTGCCTGGGC |
| 2983 | CCCAGGCAGCTGGAGAGGG | CCCTCTCCAGCTGCCTGGG |
| 2984 | CCAGGCAGCTGGAGAGGGA | TCCCTCTCCAGCTGCCTGG |
| 2985 | CAGGCAGCTGGAGAGGGAG | CTCCCTCTCCAGCTGCCTG |
| 2986 | AGGCAGCTGGAGAGGGAGG | CCTCCCTCTCCAGCTGCCT |
| 2987 | GGCAGCTGGAGAGGGAGGA | TCCTCCCTCTCCAGCTGCC |
| 2988 | GCAGCTGGAGAGGGAGGAG | CTCCTCCCTCTCCAGCTGC |
| 2989 | CAGCTGGAGAGGGAGGAGG | CCTCCTCCCTCTCCAGCTG |
| 2990 | AGCTGGAGAGGGAGGAGGG | CCCTCCTCCCTCTCCAGCT |
| 2991 | GCTGGAGAGGGAGGAGGGC | GCCCTCCTCCCTCTCCAGC |
| 2992 | CTGGAGAGGGAGGAGGGCA | TGCCCTCCTCCCTCTCCAG |
| 2993 | TGGAGAGGGAGGAGGGCAC | GTGCCCTCCTCCCTCTCCA |
| 2994 | GGAGAGGGAGGAGGGCACG | CGTGCCCTCCTCCCTCTCC |
| 2995 | GAGAGGGAGGAGGGCACGC | GCGTGCCCTCCTCCCTCTC |
| 2996 | AGAGGGAGGAGGGCACGCC | GGCGTGCCCTCCTCCCTCT |
| 2997 | GAGGGAGGAGGGCACGCCT | AGGCGTGCCCTCCTCCCTC |
| 2998 | AGGGAGGAGGGCACGCCTG | CAGGCGTGCCCTCCTCCCT |
| 2999 | GGGAGGAGGGCACGCCTGC | GCAGGCGTGCCCTCCTCCC |
| 3000 | GGAGGAGGGCACGCCTGCC | GGCAGGCGTGCCCTCCTCC |
| 3001 | GAGGAGGGCACGCCTGCCA | TGGCAGGCGTGCCCTCCTC |
| 3002 | AGGAGGGCACGCCTGCCAC | GTGGCAGGCGTGCCCTCCT |
| 3003 | GGAGGGCACGCCTGCCACT | AGTGGCAGGCGTGCCCTCC |
| 3004 | GAGGGCACGCCTGCCACTC | GAGTGGCAGGCGTGCCCTC |
| 3005 | AGGGCACGCCTGCCACTCT | AGAGTGGCAGGCGTGCCCT |
| 3006 | GGGCACGCCTGCCACTCTC | GAGAGTGGCAGGCGTGCCC |
| 3007 | GGCACGCCTGCCACTCTCA | TGAGAGTGGCAGGCGTGCC |
| 3008 | GCACGCCTGCCACTCTCAG | CTGAGAGTGGCAGGCGTGC |
| 3009 | CACGCCTGCCACTCTCAGC | GCTGAGAGTGGCAGGCGTG |
| 3010 | ACGCCTGCCACTCTCAGCA | TGCTGAGAGTGGCAGGCGT |
| 3011 | CGCCTGCCACTCTCAGCAA | TTGCTGAGAGTGGCAGGCG |
| 3012 | GCCTGCCACTCTCAGCAAG | CTTGCTGAGAGTGGCAGGC |
| 3013 | CCTGCCACTCTCAGCAAGT | ACTTGCTGAGAGTGGCAGG |
| 3014 | CTGCCACTCTCAGCAAGTG | CACTTGCTGAGAGTGGCAG |
| 3015 | TGCCACTCTCAGCAAGTGC | GCACTTGCTGAGAGTGGCA |
| 3016 | GCCACTCTCAGCAAGTGCG | CGCACTTGCTGAGAGTGGC |
| 3017 | CCACTCTCAGCAAGTGCGG | CCGCACTTGCTGAGAGTGG |
| 3018 | CACTCTCAGCAAGTGCGGA | TCCGCACTTGCTGAGAGTG |
| 3019 | ACTCTCAGCAAGTGCGGAG | CTCCGCACTTGCTGAGAGT |
| 3020 | CTCTCAGCAAGTGCGGAGA | TCTCCGCACTTGCTGAGAG |
| 3021 | TCTCAGCAAGTGCGGAGAT | ATCTCCGCACTTGCTGAGA |
| 3022 | CTCAGCAAGTGCGGAGATC | GATCTCCGCACTTGCTGAG |
| 3023 | TCAGCAAGTGCGGAGATCG | CGATCTCCGCACTTGCTGA |
| 3024 | CAGCAAGTGCGGAGATCGC | GCGATCTCCGCACTTGCTG |
| 3025 | AGCAAGTGCGGAGATCGCC | GGCGATCTCCGCACTTGCT |
| 3026 | GCAAGTGCGGAGATCGCCT | AGGCGATCTCCGCACTTGC |
| 3027 | CAAGTGCGGAGATCGCCTC | GAGGCGATCTCCGCACTTG |
| 3028 | AAGTGCGGAGATCGCCTCT | AGAGGCGATCTCCGCACTT |
| 3029 | AGTGCGGAGATCGCCTCTG | CAGAGGCGATCTCCGCACT |
| 3030 | GTGCGGAGATCGCCTCTGG | CCAGAGGCGATCTCCGCAC |
| 3031 | TGCGGAGATCGCCTCTGGG | CCCAGAGGCGATCTCCGCA |
| 3032 | GCGGAGATCGCCTCTGGGA | TCCCAGAGGCGATCTCCGC |
| 3033 | CGGAGATCGCCTCTGGGAG | CTCCCAGAGGCGATCTCCG |
| 3034 | GGAGATCGCCTCTGGGAGG | CCTCCCAGAGGCGATCTCC |
| 3035 | GAGATCGCCTCTGGGAGGG | CCCTCCCAGAGGCGATCTC |
| 3036 | AGATCGCCTCTGGGAGGGG | CCCCTCCCAGAGGCGATCT |
| 3037 | GATCGCCTCTGGGAGGGGA | TCCCCTCCCAGAGGCGATC |
| 3038 | ATCGCCTCTGGGAGGGGAG | CTCCCCTCCCAGAGGCGAT |
| 3039 | TCGCCTCTGGGAGGGGAGC | GCTCCCCTCCCAGAGGCGA |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 3040 | CGCCTCTGGGAGGGGAGCT | AGCTCCCCTCCCAGAGGCG |
| 3041 | GCCTCTGGGAGGGGAGCTG | CAGCTCCCCTCCCAGAGGC |
| 3042 | CCTCTGGGAGGGGAGCTGC | GCAGCTCCCCTCCCAGAGG |
| 3043 | CTCTGGGAGGGGAGCTGCA | TGCAGCTCCCCTCCCAGAG |
| 3044 | TCTGGGAGGGGAGCTGCAG | CTGCAGCTCCCCTCCCAGA |
| 3045 | CTGGGAGGGGAGCTGCAGC | GCTGCAGCTCCCCTCCCAG |
| 3046 | TGGGAGGGGAGCTGCAGCA | TGCTGCAGCTCCCCTCCCA |
| 3047 | GGGAGGGGAGCTGCAGCAG | CTGCTGCAGCTCCCCTCCC |
| 3048 | GGAGGGGAGCTGCAGCAGG | CCTGCTGCAGCTCCCCTCC |
| 3049 | GAGGGGAGCTGCAGCAGGA | TCCTGCTGCAGCTCCCCTC |
| 3050 | AGGGGAGCTGCAGCAGGAG | CTCCTGCTGCAGCTCCCCT |
| 3051 | GGGGAGCTGCAGCAGGAGG | CCTCCTGCTGCAGCTCCCC |
| 3052 | GGGAGCTGCAGCAGGAGGA | TCCTCCTGCTGCAGCTCCC |
| 3053 | GGAGCTGCAGCAGGAGGAA | TTCCTCCTGCTGCAGCTCC |
| 3054 | GAGCTGCAGCAGGAGGAAG | CTTCCTCCTGCTGCAGCTC |
| 3055 | AGCTGCAGCAGGAGGAAGA | TCTTCCTCCTGCTGCAGCT |
| 3056 | GCTGCAGCAGGAGGAAGAC | GTCTTCCTCCTGCTGCAGC |
| 3057 | CTGCAGCAGGAGGAAGACA | TGTCTTCCTCCTGCTGCAG |
| 3058 | TGCAGCAGGAGGAAGACAC | GTGTCTTCCTCCTGCTGCA |
| 3059 | GCAGCAGGAGGAAGACACA | TGTGTCTTCCTCCTGCTGC |
| 3060 | CAGCAGGAGGAAGACACAG | CTGTGTCTTCCTCCTGCTG |
| 3061 | AGCAGGAGGAAGACACAGC | GCTGTGTCTTCCTCCTGCT |
| 3062 | GCAGGAGGAAGACACAGCC | GGCTGTGTCTTCCTCCTGC |
| 3063 | CAGGAGGAAGACACAGCCA | TGGCTGTGTCTTCCTCCTG |
| 3064 | AGGAGGAAGACACAGCCAC | GTGGCTGTGTCTTCCTCCT |
| 3065 | GGAGGAAGACACAGCCACC | GGTGGCTGTGTCTTCCTCC |
| 3066 | GAGGAAGAGACAGCCACCA | TGGTGGCTGTGTCTTCCTC |
| 3067 | AGGAAGACACAGCCACCAA | TTGGTGGCTGTGTCTTCCT |
| 3068 | GGAAGACACAGCCACCAAC | GTTGGTGGCTGTGTCTTCC |
| 3069 | GAAGACACAGCCACCAACT | AGTTGGTGGCTGTGTCTTC |
| 3070 | AAGACACAGCCACCAACTC | GAGTTGGTGGCTGTGTCTT |
| 3071 | AGACACAGCCACCAACTCC | GGAGTTGGTGGCTGTGTCT |
| 3072 | GACACAGCCACCAACTCCA | TGGAGTTGGTGGCTGTGTC |
| 3073 | ACACAGCCACCAACTCCAG | CTGGAGTTGGTGGCTGTGT |
| 3074 | CACAGCCACCAACTCCAGC | GCTGGAGTTGGTGGCTGTG |
| 3075 | ACAGCCACCAACTCCAGCT | AGCTGGAGTTGGTGGCTGT |
| 3076 | CAGCCACCAACTCCAGCTC | GAGCTGGAGTTGGTGGCTG |
| 3077 | AGCCACCAACTCCAGCTCT | AGAGCTGGAGTTGGTGGCT |
| 3078 | GCCACCAACTCCAGCTCTG | CAGAGCTGGAGTTGGTGGC |
| 3079 | CCACCAACTCCAGCTCTGA | TCAGAGCTGGAGTTGGTGG |
| 3080 | CACCAACTCCAGCTCTGAG | CTCAGAGCTGGAGTTGGTG |
| 3081 | ACCAACTCCAGCTCTGAGG | CCTCAGAGCTGGAGTTGGT |
| 3082 | CCAACTCCAGCTCTGAGGA | TCCTCAGAGCTGGAGTTGG |
| 3083 | CAACTCCAGCTCTGAGGAA | TTCCTCAGAGCTGGAGTTG |
| 3084 | AACTCCAGCTCTGAGGAAG | CTTCCTCAGAGCTGGAGTT |
| 3085 | ACTCCAGCTCTGAGGAAGG | CCTTCCTCAGAGCTGGAGT |
| 3086 | CTCCAGCTCTGAGGAAGGC | GCCTTCCTCAGAGCTGGAG |
| 3087 | TCCAGCTCTGAGGAAGGCC | GGCCTTCCTCAGAGCTGGA |
| 3088 | CCAGCTCTGAGGAAGGCCC | GGGCCTTCCTCAGAGCTGG |
| 3089 | CAGCTCTGAGGAAGGCCCA | TGGGCCTTCCTCAGAGCTG |
| 3090 | AGCTCTGAGGAAGGCCCAG | CTGGGCCTTCCTCAGAGCT |
| 3091 | GCTCTGAGGAAGGCCCAGG | CCTGGGCCTTCCTCAGAGC |
| 3092 | CTCTGAGGAAGGCCCAGGG | CCCTGGGCCTTCCTCAGAG |
| 3093 | TCTGAGGAAGGCCCAGGGT | ACCCTGGGCCTTCCTCAGA |
| 3094 | CTGAGGAAGGCCCAGGGTC | GACCCTGGGCCTTCCTCAG |
| 3095 | TGAGGAAGGCCCAGGGTCC | GGACCCTGGGCCTTCCTCA |
| 3096 | GAGGAAGGCCCAGGGTCCG | CCGACCCTGGGCCTTCCTC |
| 3097 | AGGAAGGCCCAGGGTCCGG | CCGGACCCTGGGCCTTCCT |
| 3098 | GGAAGGCCCAGGGTCCGGC | GCCGGACCCTGGGCCTTCC |
| 3099 | GAAGGCCCAGGGTCCGGCC | GGCCGGACCCTGGGCCTTC |
| 3100 | AAGGCCCAGGGTCCGGCCC | GGGCCGGACCCTGGGCCTT |
| 3101 | AGGCCCAGGGTCCGGCCCT | AGGGCCGGACCCTGGGCCT |
| 3102 | GGCCCAGGGTCCGGCCCTG | CAGGGCCGGACCCTGGGCC |
| 3103 | GCCCAGGGTCCGGCCCTGA | TCAGGGCCGGACCCTGGGC |
| 3104 | CCCAGGGTCCGGCCCTGAC | GTCAGGGCCGGACCCTGGG |
| 3105 | CCAGGGTCCGGCCCTGACA | TGTCAGGGCCGGACCCTGG |
| 3106 | CAGGGTCCGGCCCTGACAG | CTGTCAGGGCCGGACCCTG |
| 3107 | AGGGTCCGGCCCTGACAGC | GCTGTCAGGGCCGGACCCT |
| 3108 | GGGTCCGGCCCTGACAGCG | GGCTGTCAGGGCCGGACCC |

TABLE 1-continued cDNA Human Hairless 19-mer Target Sequences and Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3109 | GGTCCGGCCCTGACAGCCG | CGGCTGTCAGGGCCGGACC |
| 3110 | GTCCGGCCCTGACAGCCGG | CCGGCTGTCAGGGCCGGAC |
| 3111 | TCCGGCCCTGACAGCCGGC | GCCGGCTGTCAGGGCCGGA |
| 3112 | CCGGCCCTGACAGCCGGCT | AGCCGGCTGTCAGGGCCGG |
| 3113 | CGGCCCTGACAGCCGGCTC | GAGCCGGCTGTCAGGGCCG |
| 3114 | GGCCCTGACAGCCGGCTCA | TGAGCCGGCTGTCAGGGCC |
| 3115 | GCCCTGACAGCCGGCTCAG | CTGAGCCGGCTGTCAGGGC |
| 3116 | CCCTGACAGCCGGCTCAGC | GCTGAGCCGGCTGTCAGGG |
| 3117 | CCTGACAGCCGGCTCAGCA | TGCTGAGCCGGCTGTCAGG |
| 3118 | CTGACAGCCGGCTCAGCAC | GTGCTGAGCCGGCTGTCAG |
| 3119 | TGACAGCCGGCTCAGCACA | TGTGCTGAGCCGGCTGTCA |
| 3120 | GACAGCCGGCTCAGCACAG | CTGTGCTGAGCCGGCTGTC |
| 3121 | ACAGCCGGCTCAGCACAGG | CCTGTGCTGAGCCGGCTGT |
| 3122 | CAGCCGGCTCAGCACAGGC | GCCTGTGCTGAGCCGGCTG |
| 3123 | AGCCGGCTCAGCACAGGCC | GGCCTGTGCTGAGCCGGCT |
| 3124 | GCCGGCTCAGCACAGGCCT | AGGCCTGTGCTGAGCCGGC |
| 3125 | CCGGCTCAGCACAGGCCTC | GAGGCCTGTGCTGAGCCGG |
| 3126 | CGGCTCAGCACAGGCCTCG | CGAGGCCTGTGCTGAGCCG |
| 3127 | GGCTCAGCACAGGCCTCGC | GCGAGGCCTGTGCTGAGCC |
| 3128 | GCTCAGCACAGGCCTCGCC | GGCGAGGCCTGTGCTGAGC |
| 3129 | CTCAGCACAGGCCTCGCCA | TGGCGAGGCCTGTGCTGAG |
| 3130 | TCAGCACAGGCCTCGCCAA | TTGGCGAGGCCTGTGCTGA |
| 3131 | CAGCACAGGCCTCGCCAAG | CTTGGCGAGGCCTGTGCTG |
| 3132 | AGCACAGGCCTCGCCAAGC | GCTTGGCGAGGCCTGTGCT |
| 3133 | GCACAGGCCTCGCCAAGCA | TGCTTGGCGAGGCCTGTGC |
| 3134 | CACAGGCCTCGCCAAGCAC | GTGCTTGGCGAGGCCTGTG |
| 3135 | ACAGGCCTCGCCAAGCACC | GGTGCTTGGCGAGGCCTGT |
| 3136 | CAGGCCTCGCCAAGCACCT | AGGTGCTTGGCGAGGCCTG |
| 3137 | AGGCCTCGCCAAGCACCTG | CAGGTGCTTGGCGAGGCCT |
| 3138 | GGCCTCGCCAAGCACCTGC | GCAGGTGCTTGGCGAGGCC |
| 3139 | GCCTCGCCAAGCACCTGCT | AGCAGGTGCTTGGCGAGGC |
| 3140 | CCTCGCCAAGCACCTGCTC | GAGCAGGTGCTTGGCGAGG |
| 3141 | CTCGCCAAGCACCTGCTCA | TGAGCAGGTGCTTGGCGAG |
| 3142 | TCGCCAAGCACCTGCTCAG | CTGAGCAGGTGCTTGGCGA |
| 3143 | CGCCAAGCACCTGCTCAGT | ACTGAGCAGGTGCTTGGCG |
| 3144 | GCCAAGCACCTGCTCAGTG | CACTGAGCAGGTGCTTGGC |
| 3145 | CCAAGCACCTGCTCAGTGG | CCACTGAGCAGGTGCTTGG |
| 3146 | CAAGCACCTGCTCAGTGGT | ACCACTGAGCAGGTGCTTG |
| 3147 | AAGCACCTGCTCAGTGGTT | AACCACTGAGCAGGTCCTT |
| 3148 | AGCACCTGCTCAGTGGTTT | AAACCACTGAGCAGGTGCT |
| 3149 | GCACCTGCTCAGTGGTTTG | CAAACCACTGAGCAGGTGC |
| 3150 | CACCTGCTCAGTGGTTTGG | CCAAACCACTGAGCAGGTG |
| 3151 | ACCTGCTCAGTGGTTTGGG | CCCAAACCACTGAGCAGGT |
| 3152 | CCTGCTCAGTGGTTTGGGG | CCCCAAACCACTGAGCAGG |
| 3153 | CTGCTCAGTGGTTTGGGGG | CCCCCAAACCACTGAGCAG |
| 3154 | TGCTCAGTGGTTTGGGGGA | TCCCCAAACCACTGAGCA |
| 3155 | GCTCAGTGGTTTGGGGGAC | GTCCCCAAACCACTGAGC |
| 3156 | CTCAGTGGTTTGGGGGACC | GGTCCCCAAACCACTGAG |
| 3157 | TCAGTGGTTTGGGGGACCG | CGGTCCCCAAACCACTGA |
| 3158 | CAGTGGTTTGGGGGACCGA | TCGGTCCCCAAACCACTG |
| 3159 | AGTGGTTTGGGGGACCGAC | GTCGGTCCCCAAACCACT |
| 3160 | GTGGTTTGGGGGACCGACT | AGTCGGTCCCCAAACCAC |
| 3161 | TGGTTTGGGGGACCGACTG | CAGTCGGTCCCCAAACCA |
| 3162 | GGTTTGGGGGACCGACTGT | ACAGTCGGTCCCCAAACC |
| 3163 | GTTTGGGGGACCGACTGTG | CACAGTCGGTCCCCAAAC |
| 3164 | TTTGGGGGACCGACTGTGC | GCACAGTCGGTCCCCAAA |
| 3165 | TTGGGGGACCGACTGTGCC | GGCACAGTCGGTCCCCAA |
| 3166 | TGGGGGACCGACTGTGCCG | CGGCACAGTCGGTCCCCCA |
| 3167 | GGGGGACCGACTGTGCCGC | GCGGCACAGTCGGTCCCCC |
| 3168 | GGGGACCGACTGTGCCGCC | GGCGGCACAGTCGGTCCCC |
| 3169 | GGGACCGACTGTGCCGCCT | AGGCGGCACAGTCGGTCCC |
| 3170 | GGACCGACTGTGCCGCCTG | CAGGCGGCACAGTCGGTCC |
| 3171 | GACCGACTGTGCCGCCTGC | GCAGGCGGCACAGTCGGTC |
| 3172 | ACCGACTGTGCCGCCTGCT | AGCAGGCGGCACAGTCGGT |
| 3173 | CCGACTGTGCCGCCTGCTG | CAGCAGGCGGCACAGTCGG |
| 3174 | CGACTGTGCCGCCTGCTGC | GCAGCAGGCGGCACAGTCG |
| 3175 | GACTGTGCCGCCTGCTGCG | CGCAGCAGGCGGCACAGTC |
| 3176 | ACTGTGCCGCCTGCTGCGG | CCGCAGCAGGCGGCACAGT |
| 3177 | CTGTGCCGCCTGCTGCGGA | TCCGCAGCAGGCGGCACAG |

TABLE 1-continued cDNA Human Hairless 19-mer Target Sequences and Complement Referenced to NM_005144-
*Homo sapiens* hairless homolog (mouse) (HR), transcript variant 1, complete mRNA (1-5699 bp).
(SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 3178 | TGTGCCGCCTGCTGCGGAG | CTCCGCAGCAGGCGGCACA |
| 3179 | GTGCCGCCTGCTGCGGAGG | CCTCCGCAGCAGGCGGCAC |
| 3180 | TGCCGCCTGCTGCGGAGGG | CCCTCCGCAGCAGGCGGCA |
| 3181 | GCCGCCTGCTGCGGAGGGA | TCCCTCCGCAGCAGGCGGC |
| 3182 | CCGCCTGCTGCGGAGGGAG | CTCCCTCCGCAGCAGGCGG |
| 3183 | CGCCTGCTGCGGAGGGAGC | GCTCCCTCCGCAGCAGGCG |
| 3184 | GCCTGCTGCGGAGGGAGCG | CGCTCCCTCCGCAGCAGGC |
| 3185 | CCTGCTGCGGAGGGAGCGG | CCGCTCCCTCCGCAGCAGG |
| 3186 | CTGCTGCGGAGGGAGCGGG | CCCGCTCCGTCCGCAGCAG |
| 3187 | TGCTGCGGAGGGAGCGGGA | TCCCGCTCCCTCCGCAGCA |
| 3188 | GCTGCGGAGGGAGCGGGAG | CTCCCGCTCCCTCCGCAGC |
| 3189 | CTGCGGAGGGAGCGGGAGG | CCTCCCGCTCCCTCCGCAG |
| 3190 | TGCGGAGGGAGCGGGAGGC | GCCTCCCGCTCCCTCCGCA |
| 3191 | GCGGAGGGAGCGGGAGGCC | GGCCTCCCGCTCCCTCCGC |
| 3192 | CGGAGGGAGCGGGAGGCCC | GGGCCTCCCGCTCCCTCCG |
| 3193 | GGAGGGAGCGGGAGGCCCT | AGGGCCTCCCGCTCCCTCC |
| 3194 | GAGGGAGCGGGAGGCCCTG | CAGGGCCTCCCGCTCCCTC |
| 3195 | AGGGAGCGGGAGGCCCTGG | CCAGGGCCTCCCGCTCCCT |
| 3196 | GGGAGCGGGAGGCCCTGGC | GCCAGGGCCTCCCGCTCCC |
| 3197 | GGAGCGGGAGGCCCTGGCT | AGCCAGGGCCTCCCGCTCC |
| 3198 | GAGCGGGAGGCCCTGGCTT | AAGCCAGGGCCTCCCGCTC |
| 3199 | AGCGGGAGGCCCTGGCTTG | CAAGCCAGGGCCTCCCGCT |
| 3200 | GCGGGAGGCCCTGGCTTGG | CCAAGCCAGGGCCTCCCGC |
| 3201 | CGGGAGGCCCTGGCTTGGG | CCCAAGCCAGGGCCTCCCG |
| 3202 | GGGAGGCCCTGGCTTGGGC | GCCCAAGCCAGGGCCTCCC |
| 3203 | GGAGGCCCTGGCTTGGGCC | GGCCCAAGCCAGGGCCTCC |
| 3204 | GAGGCCCTGGCTTGGGCCC | GGGCCCAAGCCAGGGCCTC |
| 3205 | AGGCCCTGGCTTGGGCCCA | TGGGCCCAAGCCAGGGCCT |
| 3206 | GGCCCTGGCTTGGGCCCAG | CTGGGCCCAAGCCAGGGCC |
| 3207 | GCCCTGGCTTGGGCCCAGC | GCTGGGCCCAAGCCAGGGC |
| 3208 | CCCTGGCTTGGGCCCAGCG | CGCTGGGCCCAAGCCAGGG |
| 3209 | CCTGGCTTGGGCCCAGCGG | CCGCTGGGCCCAAGCCAGG |
| 3210 | CTGGCTTGGGCCCAGCGGG | CCCGCTGGGCCCAAGCCAG |
| 3211 | TGGCTTGGGCCCAGCGGGA | TCCCGCTGGGCCCAAGCCA |
| 3212 | GGCTTGGGCCCAGCGGGAA | TTCCCGCTGGGCCCAAGCC |
| 3213 | GCTTGGGCCCAGCGGGAAG | CTTCCCGCTGGGCCCAAGC |
| 3214 | CTTGGGCCCAGCGGGAAGG | CCTTCCCGCTGGGCCCAAG |
| 3215 | TTGGGCCCAGCGGGAAGGC | GCCTTCCCGCTGGGCCCAA |
| 3216 | TGGGCCCAGCGGGAAGGCC | GGCCTTCCCGCTGGGCCCA |
| 3217 | GGGCCCAGCGGGAAGGCCA | TGGCCTTCCCGCTGGGCCC |
| 3218 | GGCCCAGCGGGAAGGCCAA | TTGGCCTTCCCGCTGGGCC |
| 3219 | GCCCAGCGGGAAGGCCAAG | CTTGGCCTTCCCGCTGGGC |
| 3220 | CCCAGCGGGAAGGCCAAGG | CCTTGGCCTTCCCGCTGGG |
| 3221 | CCAGCGGGAAGGCCAAGGG | CCCTTGGCCTTCCCGCTGG |
| 3222 | CAGCGGGAAGGCCAAGGGC | GCCCTTGGCCTTCCCGCTG |
| 3223 | AGCGGGAAGGCCAAGGGCC | GGCCCTTGGCCTTCCCGCT |
| 3224 | GCGGGAAGGCCAAGGGCCA | TGGCCCTTGGCCTTCCCGC |
| 3225 | CGGGAAGGCCAAGGGCCAG | CTGGCCCTTGGCCTTCCCG |
| 3226 | GGGAAGGCCAAGGGCCAGC | GCTGGCCCTTGGCCTTCCC |
| 3227 | GGAAGGCCAAGGGCCAGCC | GGCTGGCCCTTGGCCTTCC |
| 3228 | GAAGGCCAAGGGCCAGCCG | CGGCTGGCCCTTGGCCTTC |
| 3229 | AAGGCCAAGGGCCAGCCGT | ACGGCTGGCCCTTGGCCTT |
| 3230 | AGGCCAAGGGCCAGCCGTG | CACGGCTGGCCCTTGGCCT |
| 3231 | GGCCAAGGGCCAGCCGTGA | TCACGGCTGGCCCTTGGCC |
| 3232 | GCCAAGGGCCAGCCGTGAC | GTCACGGCTGGCCCTTGGC |
| 3233 | CCAAGGGCCAGCCGTGACA | TGTCACGGCTGGCCCTTGG |
| 3234 | CAAGGGCCAGCCGTGACAG | CTGTCACGGCTGGCCCTTG |
| 3235 | AAGGGCCAGCCGTGACAGA | TCTGTCACGGCTGGCCCTT |
| 3236 | AGGGCCAGCCGTGACAGAG | CTCTGTCACGGCTGGCCCT |
| 3237 | GGGCCAGCCGTGACAGAGG | CCTCTGTCACGGCTGGCCC |
| 3238 | GGCCAGCCGTGACAGAGGA | TCCTCTGTCACGGCTGGCC |
| 3239 | GCCAGCCGTGACAGAGGAC | GTCCTCTGTCACGGCTGGC |
| 3240 | CCAGCCGTGACAGAGGACA | TGTCCTCTGTCACGGCTGG |
| 3241 | CAGCCGTGACAGAGGACAG | CTGTCCTCTGTCACGGCTG |
| 3242 | AGCCGTGACAGAGGACAGC | GCTGTCCTCTGTCACGGCT |
| 3243 | GCCGTGACAGAGGACAGCC | GGCTGTCCTCTGTCACGGC |
| 3244 | CCGTGACACAGGACAGCCC | GGGCTGTCCTCTGTCACGG |
| 3245 | CGTGACAGAGGACAGCCCA | TGGGCTGTCCTCTGTCACG |
| 3246 | GTGACAGAGGACAGCCCAG | CTGGGCTGTCCTCTGTCAC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3247 | TGACAGAGGACAGCCCAGG | CCTGGGCTGTCCTCTGTCA |
| 3248 | GACAGAGGACAGCCCAGGC | GCCTGGGCTGTCCTCTGTC |
| 3249 | ACAGAGGACAGCCCAGGCA | TGCCTGGGCTGTCCTCTGT |
| 3250 | CAGAGGACAGCCCAGGCAT | ATGCCTGGGCTGTCCTCTG |
| 3251 | AGAGGACAGCCCAGGCATT | AATGCCTGGGCTGTCCTCT |
| 3252 | GAGGACAGCCCAGGCATTC | GAATGCCTGGGCTGTCCTC |
| 3253 | AGGACAGCCCAGGCATTCC | GGAATGCCTGGGCTGTCCT |
| 3254 | GGACAGCCCAGGCATTCCA | TGGAATGCCTGGGCTGTCC |
| 3255 | GACAGCCCAGGCATTCCAC | GTGGAATGCCTGGGCTGTC |
| 3256 | ACAGCCCAGGCATTCCACG | CGTGGAATGCCTGGGCTGT |
| 3257 | CAGCCCAGGCATTCCACGC | GCGTGGAATGCCTGGGCTG |
| 3258 | AGCCCAGGCATTCCACGCT | AGCGTGGAATGCCTGGGCT |
| 3259 | GCCCAGGCATTCCACGCTG | CAGCGTGGAATGCCTGGGC |
| 3260 | CCCAGGCATTCCACGCTGC | GCAGCGTGGAATGCCTGGG |
| 3261 | CCAGGCATTCCACGCTGCT | AGCAGCGTGGAATGCCTGG |
| 3262 | CAGGCATTCCACGCTGCTG | CAGCAGCGTGGAATGCCTG |
| 3263 | AGGCATTCCACGCTGCTGC | GCAGCAGCGTGGAATGCCT |
| 3264 | GGCATTCCACGCTGCTGCA | TGCAGCAGCGTGGAATGCC |
| 3265 | GCATTCCACGCTGCTGCAG | CTGCAGCAGCGTGGAATGC |
| 3266 | CATTCCACGCTGCTGCAGC | GCTGCAGCAGCGTGGAATG |
| 3267 | ATTCCACGCTGCTGCAGCC | GGCTGCAGCAGCGTGGAAT |
| 3268 | TTCCACGCTGCTGCAGCCG | CGGCTGCAGCAGCGTGGAA |
| 3269 | TCCACGCTGCTGCAGCCGT | ACGGCTGCAGCAGCGTGGA |
| 3270 | CCACGCTGCTGCAGCCGTT | AACGGCTGCAGCAGCGTGG |
| 3271 | CACGCTGCTGCAGCCGTTG | CAACGGCTGCAGCAGCGTG |
| 3272 | ACGCTGCTGCAGCCGTTGC | GCAACGGCTGCAGCAGCGT |
| 3273 | CGCTGCTGCAGCCGTTGCC | GGCAACGGCTGCAGCAGCG |
| 3274 | GCTGCTGCAGCCGTTGCCA | TGGCAACGGCTGCAGCAGC |
| 3275 | CTGCTGCAGCCGTTGCCAC | GTGGCAACGGCTGCAGCAG |
| 3276 | TGCTGCAGCCGTTGCCACC | GGTGGCAACGGCTGCAGCA |
| 3277 | GCTGCAGCCGTTGCCACCA | TGGTGGCAACGGCTGCAGC |
| 3278 | CTGCAGCCGTTGCCACCAT | ATGGTGGCAACGGCTGCAG |
| 3279 | TGCAGCCGTTGCCACCATG | CATGGTGGCAACGGCTGCA |
| 3280 | GCAGCCGTTGCCACCATGG | CCATGGTGGCAACGGCTGC |
| 3281 | CAGCCGTTGCCACCATGGA | TCCATGGTGGCAACGGCTG |
| 3282 | AGCCGTTGCCACCATGGAC | GTCCATGGTGGCAACGGCT |
| 3283 | GCCGTTGCCACCATGGACT | AGTCCATGGTGGCAAGGGC |
| 3284 | CCGTTGCCACCATGGACTC | GAGTCCATGGTGGCAACGG |
| 3285 | CGTTGCCACCATGGACTCT | AGAGTCCATGGTGGCAACG |
| 3286 | GTTGCCACCATGGACTCTT | AAGAGTCCATGGTGGCAAC |
| 3287 | TTGCCACCATGGACTCTTC | GAAGAGTCCATGGTGGCAA |
| 3288 | TGCCACCATGGACTCTTCA | TGAAGAGTCCATGGTGGCA |
| 3289 | GCCACCATGGACTCTTCAA | TTGAAGAGTCCATGGTGGC |
| 3290 | CCACCATGGACTCTTCAAC | GTTGAAGAGTCCATGGTGG |
| 3291 | CACCATGGACTCTTCAACA | TGTTGAAGAGTCCATGGTG |
| 3292 | ACCATGGACTCTTCAACAC | GTGTTGAAGAGTCCATGGT |
| 3293 | CCATGGACTCTTCAACACC | GGTGTTGAAGAGTCCATGG |
| 3294 | CATGGACTCTTCAACACCC | GGGTGTTGAAGAGTCCATG |
| 3295 | ATGGACTCTTCAACACCCA | TGGGTGTTGAAGAGTCCAT |
| 3296 | TGGACTCTTCAACACCCAC | GTGGGTGTTGAAGAGTCCA |
| 3297 | GGACTCTTCAACACCCACT | AGTGGGTGTTGAAGAGTCC |
| 3298 | GACTCTTCAACACCCACTG | CAGTGGGTGTTGAAGAGTC |
| 3299 | ACTCTTCAACACCCACTGG | CCAGTGGGTGTTGAAGAGT |
| 3300 | CTCTTCAACACCCACTGGC | GCCAGTGGGTGTTGAAGAG |
| 3301 | TCTTCAACACCCACTGGCG | CGCCAGTGGGTGTTGAAGA |
| 3302 | CTTCAACACCCACTGGCGA | TCGCCAGTGGGTGTTGAAG |
| 3303 | TTCAACACCCACTGGCGAT | ATCGCCAGTGGGTGTTGAA |
| 3304 | TCAACACCCACTGGCGATG | CATCGCCAGTGGGTGTTGA |
| 3305 | CAACACCCACTGGCGATGT | ACATCGCCAGTGGGTGTTG |
| 3306 | AACACCCACTGGCGATGTC | GACATCGCCAGTGGGTGTT |
| 3307 | ACACCCACTGGCGATGTCC | GGACATCGCCAGTGGGTGT |
| 3308 | CACCCACTGGCGATGTCCC | GGGACATCGCCAGTGGGTG |
| 3309 | ACCCACTGGCGATGTCCCC | GGGGACATCGCCAGTGGGT |
| 3310 | CCCACTGGCGATGTCCCCG | CGGGGACATCGCCAGTGGG |
| 3311 | CCACTGGCGATGTCCCCGC | GCGGGGACATCGCCAGTGG |
| 3312 | CACTGGCGATGTCCCCGCT | AGCGGGGACATCGCCAGTG |
| 3313 | ACTGGCGATGTCCCCGCTG | CAGCGGGGACATCGCCAGT |
| 3314 | CTGGCGATGTCCCCGCTGC | GCAGCGGGGACATCGCCAG |
| 3315 | TGGCGATGTCCCCGCTGCA | TGCAGCGGGGACATCGCCA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3316 | GGCGATGTCCCCGCTGCAG | CTGCAGCGGGGACATCGCC |
| 3317 | GCGATGTCCCCGCTGCAGC | GCTGCAGCGGGGACATCGC |
| 3318 | CGATGTCCCCGCTGCAGCC | GGCTGCAGCGGGGACATCG |
| 3319 | GATGTCCCCGCTGCAGCCA | TGGCTGCAGCGGGGACATC |
| 3320 | ATGTCCCCGCTGCAGCCAC | GTGGCTGCAGCGGGGACAT |
| 3321 | TGTCCCCGCTGCAGCCACC | GGTGGCTGCAGCGGGGACA |
| 3322 | GTCCCCGCTGCAGCCACCG | CGGTGGCTGCAGCGGGGAC |
| 3323 | TCCCCGCTGCAGCCACCGG | CCGGTGGCTGCAGCGGGGA |
| 3324 | CCCCGCTGCAGCCACCGGC | GCCGGTGGCTGCAGCGGGG |
| 3325 | CCCGCTGCAGCCACCGGCT | AGCCGGTGGCTGCAGCGGG |
| 3326 | CCGCTGCAGCCACCGGCTG | CAGCCGGTGGCTGCAGCGG |
| 3327 | CGCTGCAGCCACCGGCTGT | ACAGCCGGTGGCTGCAGCG |
| 3328 | GCTGCAGCCACCGGCTGTG | CACAGCCGGTGGCTGCAGC |
| 3329 | CTGCAGCCACCGGCTGTGT | ACACAGCCGGTGGCTGCAG |
| 3330 | TGCAGCCACCGGCTGTGTG | CACACAGCCGGTGGCTGCA |
| 3331 | GCAGCCACCGGCTGTGTGT | ACACACAGCCGGTGGCTGC |
| 3332 | CAGCCACCGGCTGTGTGTG | CACACACAGCCGGTGGCTG |
| 3333 | AGCCACCGGCTGTGTGTGG | CCACACACAGCCGGTGGCT |
| 3334 | GCCACCGGCTGTGTGTGGC | GCCACACACAGCCGGTGGC |
| 3335 | CCACCGGCTGTGTGTGGCC | GGCCACACACAGCCGGTGG |
| 3336 | CACCGGCTGTGTGTGGCCT | AGGCCACACACAGCCGGTG |
| 3337 | ACCGGCTGTGTGTGGCCTG | CAGGCCACACACAGCCGGT |
| 3338 | CCGGCTGTGTGTGGCCTGT | ACAGGCCACACACAGCCGG |
| 3339 | CGGCTGTGTGTGGCCTGTG | CACAGGCCACACACAGCCG |
| 3340 | GGCTGTGTGTGGCCTGTGG | CCACAGGCCACACACAGCC |
| 3341 | GCTGTGTGTGGCCTGTGGT | ACCACAGGCCACACACAGC |
| 3342 | CTGTGTGTGGCCTGTGGTC | GACCACAGGCCACACACAG |
| 3343 | TGTGTGTGGCCTGTGGTCG | CGACCACAGGCCACACACA |
| 3344 | GTGTGTGGCCTGTGGTCGT | ACGACCACAGGCCACACAC |
| 3345 | TGTGTGGCCTGTGGTCGTG | CACGACCACAGGCCACACA |
| 3346 | GTGTGGCCTGTGGTCGTGT | ACACGACCACAGGCCACAC |
| 3347 | TGTGGCCTGTGGTCGTGTG | CACACGACCACAGGCCACA |
| 3348 | GTGGCCTGTGGTCGTGTGG | CCACACGACCACAGGCCAC |
| 3349 | TGGCCTGTGGTCGTGTGGC | GCCACACGACCACAGGCCA |
| 3350 | GGCCTGTGGTCGTGTGGCA | TGCCACACGACCACAGGCC |
| 3351 | GCCTGTGGTCGTGTGGCAG | CTGCCACACGACCACAGGC |
| 3352 | CCTGTGGTCGTGTGGCAGG | CCTGCCACACGACCACAGG |
| 3353 | CTGTGGTCGTGTGGCAGGC | GCCTGCCACACGACCACAG |
| 3354 | TGTGGTCGTGTGGCAGGCA | TGCCTGCCACACGACCACA |
| 3355 | GTGGTCGTGTGGCAGGCAC | GTGCCTGCCACACGACCAC |
| 3356 | TGGTCGTGTGGCAGGCACT | AGTGCCTGCCACACGACCA |
| 3357 | GGTCGTGTGGCAGGCACTG | CAGTGCCTGCCACACGACC |
| 3358 | GTCGTGTGGCAGGCACTGG | CCAGTGCCTGCCACACGAC |
| 3359 | TCGTGTGGCAGGCACTGGG | CCCAGTGCCTGCCACACGA |
| 3360 | CGTGTGGCAGGCACTGGGC | GCCCAGTGCCTGCCACACG |
| 3361 | GTGTGGCAGGCACTGGGCG | CGCCCAGTGCCTGCCACAC |
| 3362 | TGTGGCAGGCACTGGGCGG | CCGCCCAGTGCCTGCCACA |
| 3363 | GTGGCAGGCACTGGGCGGG | CCCGCCCAGTGCCTGCCAC |
| 3364 | TGGCAGGCACTGGGCGGGC | GCCCGCCCAGTGCCTGCCA |
| 3365 | GGCAGGCACTGGGCGGGCC | GGCCCGCCCAGTGCCTGCC |
| 3366 | GCAGGCACTGGGCGGGCCA | TGGCCCGCCCAGTGCCTGC |
| 3367 | CAGGCACTGGGCGGGCCAG | CTGGCCCGCCCAGTGCCTG |
| 3368 | AGGCACTGGGCGGGCCAGG | CCTGGCCCGCCCAGTGCCT |
| 3369 | GGCACTGGGCGGGCCAGGG | CCCTGGCCCGCCCAGTGCC |
| 3370 | GCACTGGGCGGGCCAGGGA | TCCCTGGCCCGCCCAGTGC |
| 3371 | CACTGGGCGGGCCAGGGAG | CTCCCTGGCCCGCCCAGTG |
| 3372 | ACTGGGCGGGCCAGGGAGA | TCTCCCTGGCCCGCCCAGT |
| 3373 | CTGGGCGGGCCAGGGAGAA | TTCTCCCTGGCCCGCCCAG |
| 3374 | TGGGCGGGCCAGGGAGAAA | TTTCTCCCTGGCCCGCCCA |
| 3375 | GGGCGGGCCAGGGAGAAAG | CTTTCTCCCTGGCCCGCCC |
| 3376 | GGCGGGCCAGGGAGAAAGC | GCTTTCTCCCTGGCCCGCC |
| 3377 | GCGGGCCAGGGAGAAAGCA | TGCTTTCTCCCTGGCCCGC |
| 3378 | CGGGCCAGGGAGAAAGCAG | CTGCTTTCTCCCTGGCCCG |
| 3379 | GGGCCAGGGAGAAAGCAGG | CCTGCTTTCTCCCTGGCCC |
| 3380 | GGCCAGGGAGAAAGCAGGC | GCCTGCTTTCTCCCTGGCC |
| 3381 | GCCAGGGAGAAAGCAGGCT | AGCCTGCTTTCTCCCTGGC |
| 3382 | CCAGGGAGAAAGCAGGCTT | AAGCCTGCTTTCTCCCTGG |
| 3383 | CAGGGAGAAAGCAGGCTTT | AAAGCCTGCTTTCTCCCTG |
| 3384 | AGGGAGAAAGCAGGCTTTC | GAAAGCCTGCTTTCTCCCT |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X - 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 3385 | GGGAGAAAGCAGGCTTTCA | TGAAAGCCTGCTTTCTCCC |
| 3386 | GGAGAAAGCAGGCTTTCAG | CTGAAAGCCTGCTTTCTCC |
| 3387 | GAGAAAGCAGGCTTTCAGG | CCTGAAAGCCTGCTTTCTC |
| 3388 | AGAAAGCAGGCTTTCAGGA | TCCTGAAAGCCTGCTTTCT |
| 3389 | GAAAGCAGGCTTTCAGGAG | CTCCTGAAAGCCTGCTTTC |
| 3390 | AAAGCAGGCTTTCAGGAGC | GCTCCTGAAAGCCTGCTTT |
| 3391 | AAGCAGGCTTTCAGGAGCA | TGCTCCTGAAAGCCTGCTT |
| 3392 | AGCAGGCTTTCAGGAGCAG | CTGCTCCTGAAAGCCTGCT |
| 3393 | GCAGGCTTTCAGGAGCAGT | ACTGCTCCTGAAAGCCTGC |
| 3394 | CAGGCTTTCAGGAGCAGTC | GACTGCTCCTGAAAGCCTG |
| 3395 | AGGCTTTCAGGAGCAGTCC | GGACTGCTCCTGAAAGCCT |
| 3396 | GGCTTTCAGGAGCAGTCCG | CGGACTGCTCCTGAAAGCC |
| 3397 | GCTTTCAGGAGCAGTCCGC | GCGGACTGCTCCTGAAAGC |
| 3398 | CTTTCAGGAGCAGTCCGCG | CGCGGACTGCTCCTGAAAG |
| 3399 | TTTCAGGAGCAGTCCGCGG | CCGCGGACTGCTCCTGAAA |
| 3400 | TTCAGGAGCAGTCCGCGGA | TCCGCGGACTGCTCCTGAA |
| 3401 | TCAGGAGCAGTCCGCGGAG | CTCCGCGGACTGCTCCTGA |
| 3402 | CAGGAGCAGTCCGCGGAGG | CCTCCGCGGACTGCTCCTG |
| 3403 | AGGAGCAGTCCGCGGAGGA | TCCTCCGCGGACTGCTCCT |
| 3404 | GGAGCAGTCCGCGGAGGAG | CTCCTCCGCGGACTGCTCC |
| 3405 | GAGCAGTCCGCGGAGGAGT | ACTCCTCCGCGGACTGCTC |
| 3406 | AGCAGTCCGCGGAGGAGTG | CACTCCTCCGCGGACTGCT |
| 3407 | GCAGTCCGCGGAGGAGTGC | GCACTCCTCCGCGGACTGC |
| 3408 | CAGTCCGCGGAGGAGTGCA | TGCACTCCTCCGCGGACTG |
| 3409 | AGTCCGCGGAGGAGTGCAC | GTGCACTCCTCCGCGGACT |
| 3410 | GTCCGCGGAGGAGTGCACG | CGTGCACTCCTCCGCGGAC |
| 3411 | TCCGCGGAGGAGTGCACGC | GCGTGCACTCCTCCGCGGA |
| 3412 | CCGCGGAGGAGTGCACGCA | TGCGTGCACTCCTCCGCGG |
| 3413 | CGCGGAGGAGTGCACGCAG | CTGCGTGCACTCCTCCGCG |
| 3414 | GCGGAGGAGTGCACGCAGG | CCTGCGTGCACTCCTCCGC |
| 3415 | CGGAGGAGTGCACGCAGGA | TCCTGCGTGCACTCCTCCG |
| 3416 | GGAGGAGTGCACGCAGGAG | CTCCTGCGTGCACTCCTCC |
| 3417 | GAGGAGTGCACGCAGGAGG | CCTCCTGCGTGCACTCCTC |
| 3418 | AGGAGTGCACGCAGGAGGC | GCCTCCTGCGTGCACTCCT |
| 3419 | GGAGTGCACGCAGGAGGCC | GGCCTCCTGCGTGCACTCC |
| 3420 | GAGTGCACGCAGGAGGCCG | CGGCCTCCTGCGTGCACTC |
| 3421 | AGTGCACGCAGGAGGCCGG | CCGGCCTCCTGCGTGCACT |
| 3422 | GTGCACGCAGGAGGCCGGG | CCCGGCCTCCTGCGTGCAC |
| 3423 | TGCACGCAGGAGGCCGGGC | GCCCGGCCTCCTGCGTGCA |
| 3424 | GCACGCAGGAGGCCGGGCA | TGCCCGGCCTCCTGCGTGC |
| 3425 | CACGCAGGAGGCCGGGCAC | GTGCCCGGCCTCCTGCGTG |
| 3426 | ACGCAGGAGGCCGGGCACG | CGTGCCCGGCCTCCTGCGT |
| 3427 | CGCAGGAGGCCGGGCACGC | GCGTGCCCGGCCTCCTGCG |
| 3428 | GCAGGAGGCCGGGCACGCT | AGCGTGCCCGGCCTCCTGC |
| 3429 | CAGGAGGCCGGGCACGCTG | CAGCGTGCCCGGCCTCCTG |
| 3430 | AGGAGGCCGGGCACGCTGC | GCAGCGTGCCCGGCCTCCT |
| 3431 | GGAGGCCGGGCACGCTGCC | GGCAGCGTGCCCGGCCTCC |
| 3432 | GAGGCCGGGCACGCTGCCT | AGGCAGCGTGCCCGGCCTC |
| 3433 | AGGCCGGGCACGCTGCCTG | CAGGCAGCGTGCCCGGCCT |
| 3434 | GGCCGGGCACGCTGCCTGT | ACAGGCAGCGTGCCCGGCC |
| 3435 | GCCGGGCACGCTGCCTGTT | AACAGGCAGCGTGCCCGGC |
| 3436 | CCGGGCACGCTGCCTGTTC | GAACAGGCAGCGTGCCCGG |
| 3437 | CGGGCACGCTGCCTGTTCC | GGAACAGGCAGCGTGCCCG |
| 3438 | GGGCACGCTGCCTGTTCCC | GGGAACAGGCAGCGTGCCC |
| 3439 | GGCACGCTGCCTGTTCCCT | AGGGAACAGGCAGCGTGCC |
| 3440 | GCACGCTGCCTGTTCCCTG | CAGGGAACAGGCAGCGTGC |
| 3441 | CACGCTGCCTGTTCCCTGA | TCAGGGAACAGGCAGCGTG |
| 3442 | ACGCTGCCTGTTCCCTGAT | ATCAGGGAACAGGCAGCGT |
| 3443 | CGCTGCCTGTTCCCTGATG | CATCAGGGAACAGGCAGCG |
| 3444 | GCTGCCTGTTCCCTGATGC | GCATCAGGGAACAGGCAGC |
| 3445 | CTGCCTGTTCCCTGATGCT | AGCATCAGGGAACAGGCAG |
| 3446 | TGCCTGTTCCCTGATGCTG | CAGCATCAGGGAACAGGCA |
| 3447 | GCCTGTTCCCTGATGCTGA | TCAGCATCAGGGAACAGGC |
| 3448 | CCTGTTCCCTGATGCTGAC | GTCAGCATCAGGGAACAGG |
| 3449 | CTGTTCCCTGATGCTGACC | GGTCAGCATCAGGGAACAG |
| 3450 | TGTTCCCTGATGCTGACCC | GGGTCAGCATCAGGGAACA |
| 3451 | GTTCCCTGATGCTGACCCA | TGGGTCAGCATCAGGGAAC |
| 3452 | TTCCCTGATGCTGACCCAG | CTGGGTCAGCATCAGGGAA |
| 3453 | TCCCTGATGCTGACCCAGT | ACTGGGTCAGCATCAGGGA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3454 | CCCTGATGCTGACCCAGTT | AACTGGGTCAGCATCAGGG |
| 3455 | CCTGATGCTGACCCAGTTT | AAACTGGGTCAGCATCAGG |
| 3456 | CTGATGCTGACCCAGTTTG | CAAACTGGGTCAGCATCAG |
| 3457 | TGATGCTGACCCAGTTTGT | ACAAACTGGGTCAGCATCA |
| 3458 | GATGCTGACCCAGTTTGTC | GACAAACTGGGTCAGCATC |
| 3459 | ATGCTGACCCAGTTTGTCT | AGACAAACTGGGTCAGCAT |
| 3460 | TGCTGACCCAGTTTGTCTC | GAGACAAACTGGGTCAGCA |
| 3461 | GCTGACCCAGTTTGTCTCC | GGAGACAAACTGGGTCAGC |
| 3462 | CTGACCCAGTTTGTCTCCA | TGGAGACAAACTGGGTCAG |
| 3463 | TGACCCAGTTTGTCTCCAG | CTGGAGACAAACTGGGTCA |
| 3464 | GACCCAGTTTGTCTCCAGC | GCTGGAGACAAACTGGGTC |
| 3465 | ACCCAGTTTGTCTCCAGCC | GGCTGGAGACAAACTGGGT |
| 3466 | CCCAGTTTGTCTCCAGCCA | TGGCTGGAGACAAACTGGG |
| 3467 | CCAGTTTGTCTCCAGCCAG | CTGGCTGGAGACAAACTGG |
| 3468 | CAGTTTGTCTCCAGCCAGG | CCTGGCTGGAGACAAACTG |
| 3469 | AGTTTGTCTCCAGCCAGGC | GCCTGGCTGGAGACAAACT |
| 3470 | GTTTGTCTCCAGCCAGGCT | AGCCTGGCTGGAGACAAAC |
| 3471 | TTTGTCTCCAGCCAGGCTT | AAGCCTGGCTGGAGACAAA |
| 3472 | TTGTCTCCAGCCAGGCTTT | AAAGCCTGGCTGGAGACAA |
| 3473 | TGTCTCCAGCCAGGCTTTG | CAAAGCCTGGCTGGAGACA |
| 3474 | GTCTCCAGCCAGGCTTTGG | CCAAAGCCTGGCTGGAGAC |
| 3475 | TCTCCAGCCAGGCTTTGGC | GCCAAAGCCTGGCTGGAGA |
| 3476 | CTCCAGCCAGGCTTTGGCA | TGCCAAAGCCTGGCTGGAG |
| 3477 | TCCAGCCAGGCTTTGGCAG | CTGCCAAAGCCTGGCTGGA |
| 3478 | CCAGCCAGGCTTTGGCAGA | TCTGCCAAAGCCTGGCTGG |
| 3479 | CAGCCAGGCTTTGGCAGAG | CTCTGCCAAAGCCTGGCTG |
| 3480 | AGCCAGGCTTTGGCAGAGC | GCTCTGCCAAAGCCTGGCT |
| 3481 | GCCAGGCTTTGGCAGAGCT | AGCTCTGCCAAAGCCTGGC |
| 3482 | CCAGGCTTTGGCAGAGCTG | CAGCTCTGCCAAAGCCTGG |
| 3483 | CAGGCTTTGGCAGAGCTGA | TCAGCTCTGCCAAAGCCTG |
| 3484 | AGGCTTTGGCAGAGCTGAG | CTCAGCTCTGCCAAAGCCT |
| 3485 | GGCTTTGGCAGAGCTGAGC | GCTCAGCTCTGCCAAAGCC |
| 3486 | GCTTTGGCAGAGCTGAGCA | TGCTCAGCTCTGCCAAAGC |
| 3487 | CTTTGGCAGAGCTGAGCAC | GTGCTCAGCTCTGCCAAAG |
| 3488 | TTTGGCAGAGCTGAGCACT | AGTGCTCAGCTCTGCCAAA |
| 3489 | TTGGCAGAGCTGAGCACTG | CAGTGCTCAGCTCTGCCAA |
| 3490 | TGGCAGAGCTGAGCACTGC | GCAGTGCTCAGCTCTGCCA |
| 3491 | GGCAGAGCTGAGCACTGCA | TGCAGTGCTCAGCTCTGCC |
| 3492 | GCAGAGCTGAGCACTGCAA | TTGCAGTGCTCAGCTCTGC |
| 3493 | CAGAGCTGAGCACTGCAAT | ATTGCAGTGCTCAGCTCTG |
| 3494 | AGAGCTGAGCACTGCAATG | CATTGCAGTGCTCAGCTCT |
| 3495 | GAGCTGAGCACTGCAATGC | GCATTGCAGTGCTCAGCTC |
| 3496 | AGCTGAGCACTGCAATGCA | TGCATTGCAGTGCTCAGCT |
| 3497 | GCTGAGCACTGCAATGCAC | GTGCATTGCAGTGCTCAGC |
| 3498 | CTGAGCACTGCAATGCACC | GGTGCATTGCAGTGCTCAG |
| 3499 | TGAGCACTGCAATGCACCA | TGGTGCATTGCAGTGCTCA |
| 3500 | GAGCACTGCAATGCACCAG | CTGGTGCATTGCAGTGCTC |
| 3501 | AGCACTGCAATGCACCAGG | CCTGGTGCATTGCAGTGCT |
| 3502 | GCACTGCAATGCACCAGGT | ACCTGGTGCATTGCAGTGC |
| 3503 | CACTGCAATGCACCAGGTC | GACCTGGTGCATTGCAGTG |
| 3504 | ACTGCAATGCACCAGGTCT | AGACCTGGTGCATTGCAGT |
| 3505 | CTGCAATGCACCAGGTCTG | CAGACCTGGTGCATTGCAG |
| 3506 | TGCAATGCACCAGGTCTGG | CCAGACCTGGTGCATTGCA |
| 3507 | GCAATGCACCAGGTCTGGG | CCCAGACCTGGTGCATTGC |
| 3508 | CAATGCACCAGGTCTGGGT | ACCCAGACCTGGTGCATTG |
| 3509 | AATGCACCAGGTCTGGGTC | GACCCAGACCTGGTGCATT |
| 3510 | ATGCACCAGGTCTGGGTCA | TGACCCAGACCTGGTGCAT |
| 3511 | TGCACCAGGTCTGGGTCAA | TTGACCCAGACCTGGTGCA |
| 3512 | GCACCAGGTCTGGGTCAAG | CTTGACCCAGACCTGGTGC |
| 3513 | CACCAGGTCTGGGTCAAGT | ACTTGACCCAGACCTGGTG |
| 3514 | ACCAGGTCTGGGTCAAGTT | AACTTGACCCAGACCTGGT |
| 3515 | CCAGGTCTGGGTCAAGTTT | AAACTTGACCCAGACCTGG |
| 3516 | CAGGTCTGGGTCAAGTTTG | CAAACTTGACCCAGACCTG |
| 3517 | AGGTCTGGGTCAAGTTTGA | TCAAACTTGACCCAGACCT |
| 3518 | GGTCTGGGTCAAGTTTGAT | ATCAAACTTGACCCAGACC |
| 3519 | GTCTGGGTCAAGTTTGATA | TATCAAACTTGACCCAGAC |
| 3520 | TCTGGGTCAAGTTTGATAT | ATATCAAACTTGACCCAGA |
| 3521 | CTGGGTCAAGTTTGATATC | GATATCAAACTTGACCCAG |
| 3522 | TGGGTCAAGTTTGATATCC | GGATATCAAACTTGACCCA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3523 | GGGTCAAGTTTGATATCCG | CGGATATCAAACTTGACCC |
| 3524 | GGTCAAGTTTGATATCCGG | CCGGATATCAAACTTGACC |
| 3525 | GTCAAGTTTGATATCCGGG | CCCGGATATCAAACTTGAC |
| 3526 | TCAAGTTTGATATCCGGGG | CCCCGGATATCAAACTTGA |
| 3527 | CAAGTTTGATATCCGGGGG | CCCCCGGATATCAAACTTG |
| 3528 | AAGTTTGATATCCGGGGGC | GCCCCCGGATATCAAACTT |
| 3529 | AGTTTGATATCCGGGGGCA | TGCCCCCGGATATCAAACT |
| 3530 | GTTTGATATCCGGGGGCAC | GTGCCCCCGGATATCAAAC |
| 3531 | TTTGATATCCGGGGGCACT | AGTGCCCCCGGATATCAAA |
| 3532 | TTGATATCCGGGGGCACTG | CAGTGCCCCCGGATATCAA |
| 3533 | TGATATCCGGGGGCACTGC | GCAGTGCCCCCGGATATCA |
| 3534 | GATATCCGGGGGCACTGCC | GGCAGTGCCCCCGGATATC |
| 3535 | ATATCCGGGGGCACTGCCC | GGGCAGTGCCCCCGGATAT |
| 3536 | TATCCGGGGGCACTGCCCC | GGGGCAGTGCCCCCGGATA |
| 3537 | ATCCGGGGGCACTGCCCCT | AGGGGCAGTGCCCCCGGAT |
| 3538 | TCCGGGGGCACTGCCCCTG | CAGGGGCAGTGCCCCCGGA |
| 3539 | CCGGGGGCACTGCCCCTGC | GCAGGGGCAGTGCCCCCGG |
| 3540 | CGGGGGCACTGCCCCTGCC | GGCAGGGGCAGTGCCCCCG |
| 3541 | GGGGGCACTGCCCCTGCCA | TGGCAGGGGCAGTGCCCCC |
| 3542 | GGGGCACTGCCCCTGCCAA | TTGGCAGGGGCAGTGCCCC |
| 3543 | GGGCACTGCCCCTGCCAAG | CTTGGCAGGGGCAGTGCCC |
| 3544 | GGCACTGCCCCTGCCAAGC | GCTTGGCAGGGGCAGTGCC |
| 3545 | GCACTGCCCCTGCCAAGCT | AGCTTGGCAGGGGCAGTGC |
| 3546 | CACTGCCCCTGCCAAGCTG | CAGCTTGGCAGGGGCAGTG |
| 3547 | ACTGCCCCTGCCAAGCTGA | TCAGCTTGGCAGGGGCAGT |
| 3548 | CTGCCCCTGCCAAGCTGAT | ATCAGCTTGGCAGGGGCAG |
| 3549 | TGCCCCTGCCAAGCTGATG | CATCAGCTTGGCAGGGGCA |
| 3550 | GCCCCTGCCAAGCTGATGC | GCATCAGCTTGGCAGGGGC |
| 3551 | CCCCTGCCAAGCTGATGCC | GGCATCAGCTTGGCAGGGG |
| 3552 | CCCTGCCAAGCTGATGCCC | GGGCATCAGCTTGGCAGGG |
| 3553 | CCTGCCAAGCTGATGCCCG | CGGGCATCAGCTTGGCAGG |
| 3554 | CTGCCAAGCTGATGCCCGG | CCGGGCATCAGCTTGGCAG |
| 3555 | TGCCAAGCTGATGCCCGGG | CCCGGGCATCAGCTTGGCA |
| 3556 | GCCAAGCTGATGCCCGGGT | ACCCGGGCATCAGCTTGGC |
| 3557 | CCAAGCTGATGCCCGGGTA | TACCCGGGCATCAGCTTGG |
| 3558 | CAAGCTGATGCCCGGGTAT | ATACCCGGGCATCAGCTTG |
| 3559 | AAGCTGATGCCCGGGTATG | CATACCCGGGCATCAGCTT |
| 3560 | AGCTGATGCCCGGGTATGG | CCATACCCGGGCATCAGCT |
| 3561 | GCTGATGCCCGGGTATGGG | CCCATACCCGGGCATCAGC |
| 3562 | CTGATGCCCGGGTATGGGC | GCCCATACCCGGGCATCAG |
| 3563 | TGATGCCCGGGTATGGGCC | GGCCCATACCCGGGCATCA |
| 3564 | GATGCCCGGGTATGGGCCC | GGGCCCATACCCGGGCATC |
| 3565 | ATGCCCGGGTATGGGCCCC | GGGGCCCATACCCGGGCAT |
| 3566 | TGCCCGGGTATGGGCCCCC | GGGGGCCCATACCCGGGCA |
| 3567 | GCCCGGGTATGGGCCCCCG | CGGGGGCCCATACCCGGGC |
| 3568 | CCCGGGTATGGGCCCCCGG | CCGGGGGCCCATACCCGGG |
| 3569 | CCGGGTATGGGCCCCCGGG | CCCGGGGGCCCATACCCGG |
| 3570 | CGGGTATGGGCCCCCGGGG | CCCCGGGGGCCCATACCCG |
| 3571 | GGGTATGGGCCCCCGGGGA | TCCCCGGGGGCCCATACCC |
| 3572 | GGTATGGGCCCCCGGGGAT | ATCCCCGGGGGCCCATACC |
| 3573 | GTATGGGCCCCCGGGGATG | CATCCCCGGGGGCCCATAC |
| 3574 | TATGGGCCCCCGGGGATGC | GCATCCCCGGGGGCCCATA |
| 3575 | ATGGGCCCCCGGGGATGCA | TGCATCCCCGGGGGCCCAT |
| 3576 | TGGGCCCCCGGGGATGCAG | CTGCATCCCCGGGGGCCCA |
| 3577 | GGGCCCCCGGGGATGCAGG | CCTGCATCCCCGGGGGCCC |
| 3578 | GGCCCCCGGGGATGCAGGC | GCCTGCATCCCCGGGGGCC |
| 3579 | GCCCCCGGGGATGCAGGCC | GGCCTGCATCCCCGGGGGC |
| 3580 | CCCCCGGGGATGCAGGCCA | TGGCCTGCATCCCCGGGGG |
| 3581 | CCCCGGGGATGCAGGCCAG | CTGGCCTGCATCCCCGGGG |
| 3582 | CCCGGGGATGCAGGCCAGC | GCTGGCCTGCATCCCCGGG |
| 3583 | CCGGGGATGCAGGCCAGCA | TGCTGGCCTGCATCCCCGG |
| 3584 | CGGGGATGCAGGCCAGCAG | CTGCTGGCCTGCATCCCCG |
| 3585 | GGGGATGCAGGCCAGCAGA | TCTGCTGGCCTGCATCCCC |
| 3586 | GGGATGCAGGCCAGCAGAA | TTCTGCTGGCCTGCATCCC |
| 3587 | GGATGCAGGCCAGCAGAAG | CTTCTGCTGGCCTGCATCC |
| 3588 | GATGCAGGCCAGCAGAAGG | CCTTCTGCTGGCCTGCATC |
| 3589 | ATGCAGGCCAGCAGAAGGA | TCCTTCTGCTGGCCTGCAT |
| 3590 | TGCAGGCCAGCAGAAGGAA | TTCCTTCTGCTGGCCTGCA |
| 3591 | GCAGGCCAGCAGAAGGAAT | ATTCCTTCTGCTGGCCTGC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 3592 | CAGGCCAGCAGAAGGAATC | GATTCCTTCTGCTGGCCTG |
| 3593 | AGGCCAGCAGAAGGAATCA | TGATTCCTTCTGCTGGCCT |
| 3594 | GGCCAGCAGAAGGAATCAA | TTGATTCCTTCTGCTGGCC |
| 3595 | GCCAGCAGAAGGAATCAAC | GTTGATTCCTTCTGCTGGC |
| 3596 | CCAGCAGAAGGAATCAACA | TGTTGATTCCTTCTGCTGG |
| 3597 | CAGCAGAAGGAATCAACAC | GTGTTGATTCCTTCTGCTG |
| 3598 | AGCAGAAGGAATCAACACA | TGTGTTGATTCCTTCTGCT |
| 3599 | GCAGAAGGAATCAACACAG | CTGTGTTGATTCCTTCTGC |
| 3600 | CAGAAGGAATCAACACAGA | TCTGTGTTGATTCCTTCTG |
| 3601 | AGAAGGAATCAACACAGAA | TTCTGTGTTGATTCCTTCT |
| 3602 | GAAGGAATCAACACAGAAA | TTTCTGTGTTGATTCCTTC |
| 3603 | AAGGAATCAACACAGAAAA | TTTTCTGTGTTGATTCCTT |
| 3604 | AGGAATCAACACAGAAAAC | GTTTTCTGTGTTGATTCCT |
| 3605 | GGAATCAACACAGAAAACG | CGTTTTCTGTGTTGATTCC |
| 3606 | GAATCAACACAGAAAACGC | GCGTTTTCTGTGTTGATTC |
| 3607 | AATCAACACAGAAAACGCC | GGCGTTTTCTGTGTTGATT |
| 3608 | ATCAACACAGAAAACGCCC | GGGCGTTTTCTGTGTTGAT |
| 3609 | TCAACACAGAAAACGCCCC | GGGGCGTTTTCTGTGTTGA |
| 3610 | CAACACAGAAAACGCCCCC | GGGGGCGTTTTCTGTGTTG |
| 3611 | AACACAGAAAACGCCCCCA | TGGGGGCGTTTTCTGTGTT |
| 3612 | ACACAGAAAACGCCCCCAA | TTGGGGGCGTTTTCTGTGT |
| 3613 | CACAGAAAACGCCCCCAAC | GTTGGGGGCGTTTTCTGTG |
| 3614 | ACAGAAAACGCCCCCAACT | AGTTGGGGGCGTTTTCTGT |
| 3615 | CAGAAAACGCCCCCAACTC | GAGTTGGGGGCGTTTTCTG |
| 3616 | AGAAAACGCCCCCAACTCC | GGAGTTGGGGGCGTTTTCT |
| 3617 | GAAAACGCCCCCAACTCCA | TGGAGTTGGGGGCGTTTTC |
| 3618 | AAAACGCCCCCAACTCCAC | GTGGAGTTGGGGGCGTTTT |
| 3619 | AAACGCCCCCAACTCCACA | TGTGGAGTTGGGGGCGTTT |
| 3620 | AACGCCCCCAACTCCACAA | TTGTGGAGTTGGGGGCGTT |
| 3621 | ACGCCCCCAACTCCACAAC | GTTGTGGAGTTGGGGGCGT |
| 3622 | CGCCCCCAACTCCACAACC | GGTTGTGGAGTTGGGGGCG |
| 3623 | GCCCCCAACTCCACAACCT | AGGTTGTGGAGTTGGGGGC |
| 3624 | CCCCCAACTCCACAACCTT | AAGGTTGTGGAGTTGGGGG |
| 3625 | CCCCAACTCCACAACCTTC | GAAGGTTGTGGAGTTGGGG |
| 3626 | CCCAACTCCACAACCTTCC | GGAAGGTTGTGGAGTTGGG |
| 3627 | CCAACTCCACAACCTTCCT | AGGAAGGTTGTGGAGTTGG |
| 3628 | CAACTCCACAACCTTCCTG | CAGGAAGGTTGTGGAGTTG |
| 3629 | AACTCCACAACCTTCCTGC | GCAGGAAGGTTGTGGAGTT |
| 3630 | ACTCCACAACCTTCCTGCA | TGCAGGAAGGTTGTGGAGT |
| 3631 | CTCCACAACCTTCCTGCAA | TTGCAGGAAGGTTGTGGAG |
| 3632 | TCCACAACCTTCCTGCAAT | ATTGCAGGAAGGTTGTGGA |
| 3633 | CCACAACCTTCCTGCAATG | CATTGCAGGAAGGTTGTGG |
| 3634 | CACAACCTTCCTGCAATGG | CCATTGCAGGAAGGTTGTG |
| 3635 | ACAACCTTCCTGCAATGGC | GCCATTGCAGGAAGGTTGT |
| 3636 | CAACCTTCCTGCAATGGCG | CGCCATTGCAGGAAGGTTG |
| 3637 | AACCTTCCTGCAATGGCGA | TCGCCATTGCAGGAAGGTT |
| 3638 | ACCTTCCTGCAATGGCGAC | GTCGCCATTGCAGGAAGGT |
| 3639 | CCTTCCTGCAATGGCGACA | TGTCGCCATTGCAGGAAGG |
| 3640 | CTTCCTGCAATGGCGACAC | GTGTCGCCATTGCAGGAAG |
| 3641 | TTCCTGCAATGGCGACACC | GGTGTCGCCATTGCAGGAA |
| 3642 | TCCTGCAATGGCGACACCC | GGGTGTCGCCATTGCAGGA |
| 3643 | CCTGCAATGGCGACACCCA | TGGGTGTCGCCATTGCAGG |
| 3644 | CTGCAATGGCGACACCCAC | GTGGGTGTCGCCATTGCAG |
| 3645 | TGCAATGGCGACACCCACA | TGTGGGTGTCGCCATTGCA |
| 3646 | GCAATGGCGACACCCACAG | CTGTGGGTGTCGCCATTGC |
| 3647 | CAATGGCGACACCCACAGG | CCTGTGGGTGTCGCCATTG |
| 3648 | AATGGCGACACCCACAGGA | TCCTGTGGGTGTCGCCATT |
| 3649 | ATGGCGACACCCACAGGAC | GTCCTGTGGGTGTCGCCAT |
| 3650 | TGGCGACACCCACAGGACC | GGTCCTGTGGGTGTCGCCA |
| 3651 | GGCGACACCCACAGGACCA | TGGTCCTGTGGGTGTCGCC |
| 3652 | GCGACACCCACAGGACCAA | TTGGTCCTGTGGGTGTCGC |
| 3653 | CGACACCCACAGGACCAAG | CTTGGTCCTGTGGGTGTCG |
| 3654 | GACACCCACAGGACCAAGA | TCTTGGTCCTGTGGGTGTC |
| 3655 | ACACCCACAGGACCAAGAG | CTCTTGGTCCTGTGGGTGT |
| 3656 | CACCCACAGGACCAAGAGC | GCTCTTGGTCCTGTGGGTG |
| 3657 | ACCCACAGGACCAAGAGCA | TGCTCTTGGTCCTGTGGGT |
| 3658 | CCCACAGGACCAAGAGCAT | ATGCTCTTGGTCCTGTGGG |
| 3659 | CCACAGGACCAAGAGCATC | GATGCTCTTGGTCCTGTGG |
| 3660 | CACAGGACCAAGAGCATCA | TGATGCTCTTGGTCCTGTG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 3661 | ACAGGACCAAGAGCATCAA | TTGATGCTCTTGGTCCTGT |
| 3662 | CAGGACCAAGAGCATCAAA | TTTGATGCTCTTGGTCCTG |
| 3663 | AGGACCAAGAGCATCAAAG | CTTTGATGCTCTTGGTCCT |
| 3664 | GGACCAAGAGCATCAAAGA | TCTTTGATGCTCTTGGTCC |
| 3665 | GACCAAGAGCATCAAAGAG | CTCTTTGATGCTCTTGGTC |
| 3666 | ACCAAGAGCATCAAAGAGG | CCTCTTTGATGCTCTTGGT |
| 3667 | CCAAGAGCATCAAAGAGGA | TCCTCTTTGATGCTCTTGG |
| 3668 | CAAGAGCATCAAAGAGGAG | CTCCTCTTTGATGCTCTTG |
| 3669 | AAGAGCATCAAAGAGGAGA | TCTCCTCTTTGATGCTCTT |
| 3670 | AGAGCATCAAAGAGGAGAC | GTCTCCTCTTTGATGCTCT |
| 3671 | GAGCATCAAAGAGGAGACC | GGTCTCCTCTTTGATGCTC |
| 3672 | AGCATCAAAGAGGAGACCC | GGGTCTCCTCTTTGATGCT |
| 3673 | GCATCAAAGAGGAGACCCC | GGGGTCTCCTCTTTGATGC |
| 3674 | CATCAAAGAGGAGACCCCC | GGGGGTCTCCTCTTTGATG |
| 3675 | ATCAAAGAGGAGACCCCCG | CGGGGGTCTCCTCTTTGAT |
| 3676 | TCAAAGAGGAGACCCCCGA | TCGGGGGTCTCCTCTTTGA |
| 3677 | CAAAGAGGAGACCCCCGAT | ATCGGGGGTCTCCTCTTTG |
| 3678 | AAAGAGGAGACCCCCGATT | AATCGGGGGTCTCCTCTTT |
| 3679 | AAGAGGAGACCCCCGATTC | GAATCGGGGGTCTCCTCTT |
| 3680 | AGAGGAGACCCCCGATTCC | GGAATCGGGGGTCTCCTCT |
| 3681 | GAGGAGACCCCCGATTCCG | CGGAATCGGGGGTCTCCTC |
| 3682 | AGGAGACCCCCGATTCCGC | GCGGAATCGGGGGTCTCCT |
| 3683 | GGAGACCCCCGATTCCGCT | AGCGGAATCGGGGGTCTCC |
| 3684 | GAGACCCCCGATTCCGCTG | CAGCGGAATCGGGGGTCTC |
| 3685 | AGACCCCCGATTCCGCTGA | TCAGCGGAATCGGGGGTCT |
| 3686 | GACCCCCGATTCCGCTGAG | CTCAGCGGAATCGGGGGTC |
| 3687 | ACCCCCGATTCCGCTGAGA | TCTCAGCGGAATCGGGGGT |
| 3688 | CCCCCGATTCCGCTGAGAC | GTCTCAGCGGAATCGGGGG |
| 3689 | CCCCGATTCCGCTGAGACC | GGTCTCAGCGGAATCGGGG |
| 3690 | CCCGATTCCGCTGAGACCC | GGGTCTCAGCGGAATCGGG |
| 3691 | CCGATTCCGCTGAGACCCC | GGGGTCTCAGCGGAATCGG |
| 3692 | CGATTCCGCTGAGACCCCA | TGGGGTCTCAGCGGAATCG |
| 3693 | GATTCCGCTGAGACCCCAG | CTGGGGTCTCAGCGGAATC |
| 3694 | ATTCCGCTGAGACCCCAGC | GCTGGGGTCTCAGCGGAAT |
| 3695 | TTCCGCTGAGACCCCAGCA | TGCTGGGGTCTCAGCGGAA |
| 3696 | TCCGCTGAGACCCCAGCAG | CTGCTGGGGTCTCAGCGGA |
| 3697 | CCGCTGAGACCCCAGCAGA | TCTGCTGGGGTCTCAGCGG |
| 3698 | CGCTGAGACCCCAGCAGAG | CTCTGCTGGGGTCTCAGCG |
| 3699 | GCTGAGACCCCAGCAGAGG | CCTCTGCTGGGGTCTCAGC |
| 3700 | CTGAGACCCCAGCAGAGGA | TCCTCTGCTGGGGTCTCAG |
| 3701 | TGAGACCCCAGCAGAGGAC | GTCCTCTGCTGGGGTCTCA |
| 3702 | GAGACCCCAGCAGAGGACC | GGTCCTCTGCTGGGGTCTC |
| 3703 | AGACCCCAGCAGAGGACCG | CGGTCCTCTGCTGGGGTCT |
| 3704 | GACCCCAGCAGAGGACCGT | ACGGTCCTCTGCTGGGGTC |
| 3705 | ACCCCAGCAGAGGACCGTG | CACGGTCCTCTGCTGGGGT |
| 3706 | CCCCAGCAGAGGACCGTGC | GCACGGTCCTCTGCTGGGG |
| 3707 | CCCAGCAGAGGACCGTGCT | AGCACGGTCCTCTGCTGGG |
| 3708 | CCAGCAGAGGACCGTGCTG | CAGCACGGTCCTCTGCTGG |
| 3709 | CAGCAGAGGACCGTGCTGG | CCAGCACGGTCCTCTGCTG |
| 3710 | AGCAGAGGACCGTGCTGGC | GCCAGCACGGTCCTCTGCT |
| 3711 | GCAGAGGACCGTGCTGGCC | GGCCAGCACGGTCCTCTGC |
| 3712 | CAGAGGACCGTGCTGGCCG | CGGCCAGCACGGTCCTCTG |
| 3713 | AGAGGACCGTGCTGGCCGA | TCGGCCAGCACGGTCCTCT |
| 3714 | GAGGACCGTGCTGGCCGAG | CTCGGCCAGCACGGTCCTC |
| 3715 | AGGACCGTGCTGGCCGAGG | CCTCGGCCAGCACGGTCCT |
| 3716 | GGACCGTGCTGGCCGAGGG | CCCTCGGCCAGCACGGTCC |
| 3717 | GACCGTGCTGGCCGAGGGC | GCCCTCGGCCAGCACGGTC |
| 3718 | ACCGTGCTGGCCGAGGGCC | GGCCCTCGGCCAGCACGGT |
| 3719 | CCGTGCTGGCCGAGGGCCC | GGGCCCTCGGCCAGCACGG |
| 3720 | CGTGCTGGCCGAGGGCCCC | GGGGCCCTCGGCCAGCACG |
| 3721 | GTGCTGGCCGAGGGCCCCT | AGGGGCCCTCGGCCAGCAC |
| 3722 | TGCTGGCCGAGGGCCCCTG | CAGGGGCCCTCGGCCAGCA |
| 3723 | GCTGGCCGAGGGCCCCTGC | GCAGGGGCCCTCGGCCAGC |
| 3724 | CTGGCCGAGGGCCCCTGCC | GGCAGGGGCCCTCGGCCAG |
| 3725 | TGGCCGAGGGCCCCTGCCT | AGGCAGGGGCCCTCGGCCA |
| 3726 | GGCCGAGGGCCCCTGCCTT | AAGGCAGGGGCCCTCGGCC |
| 3727 | GCCGAGGGCCCCTGCCTTG | CAAGGCAGGGGCCCTCGGC |
| 3728 | CCGAGGGCCCCTGCCTTGT | ACAAGGCAGGGGCCCTCGG |
| 3729 | CGAGGGCCCCTGCCTTGTC | GACAAGGCAGGGGCCCTCG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3730 | GAGGGCCCCTGCCTTGTCC | GGACAAGGCAGGGGCCCTC |
| 3731 | AGGGCCCCTGCCTTGTCCT | AGGACAAGGCAGGGGCCCT |
| 3732 | GGGCCCCTGCCTTGTCCTT | AAGGACAAGGCAGGGGCCC |
| 3733 | GGCCCCTGCCTTGTCCTTC | GAAGGACAAGGCAGGGGCC |
| 3734 | GCCCCTGCCTTGTCCTTCT | AGAAGGACAAGGCAGGGGC |
| 3735 | CCCCTGCCTTGTCCTTCTC | GAGAAGGACAAGGCAGGGG |
| 3736 | CCCTGCCTTGTCCTTCTCT | AGAGAAGGACAAGGCAGGG |
| 3737 | CCTGCCTTGTCCTTCTCTC | GAGAGAAGGACAAGGCAGG |
| 3738 | CTGCCTTGTCCTTCTCTCT | AGAGAGAAGGACAAGGCAG |
| 3739 | TGCCTTGTCCTTCTCTCTG | CAGAGAGAAGGACAAGGCA |
| 3740 | GCCTTGTCCTTCTCTCTGC | GCAGAGAGAAGGACAAGGC |
| 3741 | CCTTGTCCTTCTCTCTGCG | CGCAGAGAGAAGGACAAGG |
| 3742 | CTTGTCCTTCTCTCTGCGA | TCGCAGAGAGAAGGACAAG |
| 3743 | TTGTCCTTCTCTCTGCGAA | TTCGCAGAGAGAAGGACAA |
| 3744 | TGTCCTTCTCTCTGCGAAC | GTTCGCAGAGAGAAGGACA |
| 3745 | GTCCTTCTCTCTGCGAACT | AGTTCGCAGAGAGAAGGAC |
| 3746 | TCCTTCTCTCTGCGAACTG | CAGTTCGCAGAGAGAAGGA |
| 3747 | CCTTCTCTCTGCGAACTGC | GCAGTTCGCAGAGAGAAGG |
| 3748 | CTTCTCTCTGCGAACTGCT | AGCAGTTCGCAGAGAGAAG |
| 3749 | TTCTCTCTGCGAACTGCTG | CAGCAGTTCGCAGAGAGAA |
| 3750 | TCTCTCTGCGAACTGCTGG | CCAGCAGTTCGCAGAGAGA |
| 3751 | CTCTCTGCGAACTGCTGGC | GCCAGCAGTTCGCAGAGAG |
| 3752 | TCTCTGCGAACTGCTGGCT | AGCCAGCAGTTCGCAGAGA |
| 3753 | CTCTGCGAACTGCTGGCTT | AAGCCAGCAGTTCGCAGAG |
| 3754 | TCTGCGAACTGCTGGCTTC | GAAGCCAGCAGTTCGCAGA |
| 3755 | CTGCGAACTGCTGGCTTCT | AGAAGCCAGCAGTTCGCAG |
| 3756 | TGCGAACTGCTGGCTTCTA | TAGAAGCCAGCAGTTCGCA |
| 3757 | GCGAACTGCTGGCTTCTAC | GTAGAAGCCAGCAGTTCGC |
| 3758 | CGAACTGCTGGCTTCTACC | GGTAGAAGCCAGCAGTTCG |
| 3759 | GAACTGCTGGCTTCTACCG | CGGTAGAAGCCAGCAGTTC |
| 3760 | AACTGCTGGCTTCTACCGC | GCGGTAGAAGCCAGCAGTT |
| 3761 | ACTGCTGGCTTCTACCGCG | CGCGGTAGAAGCCAGCAGT |
| 3762 | CTGCTGGCTTCTACCGCGG | CCGCGGTAGAAGCCAGCAG |
| 3763 | TGCTGGCTTCTACCGCGGT | ACCGCGGTAGAAGCCAGCA |
| 3764 | GCTGGCTTCTACCGCGGTC | GACCGCGGTAGAAGCCAGC |
| 3765 | CTGGCTTCTACCGCGGTCA | TGACCGCGGTAGAAGCCAG |
| 3766 | TGGCTTCTACCGCGGTCAA | TTGACCGCGGTAGAAGCCA |
| 3767 | GGCTTCTACCGCGGTCAAA | TTTGACCGCGGTAGAAGCC |
| 3768 | GCTTCTACCGCGGTCAAAC | GTTTGACCGCGGTAGAAGC |
| 3769 | CTTCTACCGCGGTCAAACT | AGTTTGACCGCGGTAGAAG |
| 3770 | TTCTACCGCGGTCAAACTC | GAGTTTGACCGCGGTAGAA |
| 3771 | TCTACCGCGGTCAAACTCT | AGAGTTTGACCGCGGTAGA |
| 3772 | CTACCGCGGTCAAACTCTG | CAGAGTTTGACCGCGGTAG |
| 3773 | TACCGCGGTCAAACTCTGC | GCAGAGTTTGACCGCGGTA |
| 3774 | ACCGCGGTCAAACTCTGCT | AGCAGAGTTTGACCGCGGT |
| 3775 | CCGCGGTCAAACTCTGCTT | AAGCAGAGTTTGACCGCGG |
| 3776 | CGCGGTCAAACTCTGCTTG | CAAGCAGAGTTTGACCGCG |
| 3777 | GCGGTCAAACTCTGCTTGG | CCAAGCAGAGTTTGACCGC |
| 3778 | CGGTCAAACTCTGCTTGGG | CCCAAGCAGAGTTTGACCG |
| 3779 | GGTCAAACTCTGCTTGGGC | GCCCAAGCAGAGTTTGACC |
| 3780 | GTCAAACTCTGCTTGGGCC | GGCCCAAGCAGAGTTTGAC |
| 3781 | TCAAACTCTGCTTGGGCCA | TGGCCCAAGCAGAGTTTGA |
| 3782 | CAAACTCTGCTTGGGCCAT | ATGGCCCAAGCAGAGTTTG |
| 3783 | AAACTCTGCTTGGGCCATG | CATGGCCCAAGCAGAGTTT |
| 3784 | AACTCTGCTTGGGCCATGA | TCATGGCCCAAGCAGAGTT |
| 3785 | ACTCTGCTTGGGCCATGAG | CTCATGGCCCAAGCAGAGT |
| 3786 | CTCTGCTTGGGCCATGAGC | GCTCATGGCCCAAGCAGAG |
| 3787 | TCTGCTTGGGCCATGAGCG | CGCTCATGGCCCAAGCAGA |
| 3788 | CTGCTTGGGCCATGAGCGA | TCGCTCATGGCCCAAGCAG |
| 3789 | TGCTTGGGCCATGAGCGAA | TTCGCTCATGGCCCAAGCA |
| 3790 | GCTTGGGCCATGAGCGAAT | ATTCGCTCATGGCCCAAGC |
| 3791 | CTTGGGCCATGAGCGAATA | TATTCGCTCATGGCCCAAG |
| 3792 | TTGGGCCATGAGCGAATAC | GTATTCGCTCATGGCCCAA |
| 3793 | TGGGCCATGAGCGAATACA | TGTATTCGCTCATGGCCCA |
| 3794 | GGGCCATGAGCGAATACAC | GTGTATTCGCTCATGGCCC |
| 3795 | GGCCATGAGCGAATACACA | TGTGTATTCGCTCATGGCC |
| 3796 | GCCATGAGCGAATACACAT | ATGTGTATTCGCTCATGGC |
| 3797 | CCATGAGCGAATACACATG | CATGTGTATTCGCTCATGG |
| 3798 | CATGAGCGAATACACATGG | CCATGTGTATTCGCTCATG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3799 | ATGAGCGAATACACATGGC | GCCATGTGTATTCGCTCAT |
| 3800 | TGAGCGAATACACATGGCC | GGCCATGTGTATTCGCTCA |
| 3801 | GAGCGAATACACATGGCCT | AGGCCATGTGTATTCGCTC |
| 3802 | AGCGAATACACATGGCCTT | AAGGCCATGTGTATTCGCT |
| 3803 | GCGAATACACATGGCCTTC | GAAGGCCATGTGTATTCGC |
| 3804 | CGAATACACATGGCCTTCG | CGAAGGCCATGTGTATTCG |
| 3805 | GAATACACATGGCCTTCGC | GCGAAGGCCATGTGTATTC |
| 3806 | AATACACATGGCCTTCGCC | GGCGAAGGCCATGTGTATT |
| 3807 | ATACACATGGCCTTCGCCC | GGGCGAAGGCCATGTGTAT |
| 3808 | TACACATGGCCTTCGCCCC | GGGGCGAAGGCCATGTGTA |
| 3809 | ACACATGGCCTTCGCCCCC | GGGGGCGAAGGCCATGTGT |
| 3810 | CACATGGCCTTCGCCCCCG | CGGGGGCGAAGGCCATGTG |
| 3811 | ACATGGCCTTCGCCCCCGT | ACGGGGGCGAAGGCCATGT |
| 3812 | CATGGCCTTCGCCCCCGTC | GACGGGGGCGAAGGCCATG |
| 3813 | ATGGCCTTCGCCCCCGTCA | TGACGGGGGCGAAGGCCAT |
| 3814 | TGGCCTTCGCCCCCGTCAC | GTGACGGGGGCGAAGGCCA |
| 3815 | GGCCTTCGCCCCCGTCACT | AGTGACGGGGGCGAAGGCC |
| 3816 | GCCTTCGCCCCCGTCACTC | GAGTGACGGGGGCGAAGGC |
| 3817 | CCTTCGCCCCCGTCACTCC | GGAGTGACGGGGGCGAAGG |
| 3818 | CTTCGCCCCCGTCACTCCG | CGGAGTGACGGGGGCGAAG |
| 3819 | TTCGCCCCCGTCACTCCGG | CCGGAGTGACGGGGGCGAA |
| 3820 | TCGCCCCCGTCACTCCGGC | GCCGGAGTGACGGGGGCGA |
| 3821 | CGCCCCCGTCACTCCGGCC | GGCCGGAGTGACGGGGGCG |
| 3822 | GCCCCCGTCACTCCGGCCC | GGGCCGGAGTGACGGGGGC |
| 3823 | CCCCCGTCACTCCGGCCCT | AGGGCCGGAGTGACGGGGG |
| 3824 | CCCCGTCACTCCGGCCCTG | CAGGGCCGGAGTGACGGGG |
| 3825 | CCCGTCACTCCGGCCCTGC | GCAGGGCCGGAGTGACGGG |
| 3826 | CCGTCACTCCGGCCCTGCC | GGCAGGGCCGGAGTGACGG |
| 3827 | CGTCACTCCGGCCCTGCCC | GGGCAGGGCCGGAGTGACG |
| 3828 | GTCACTCCGGCCCTGCCCA | TGGGCAGGGCCGGAGTGAC |
| 3829 | TCACTCCGGCCCTGCCCAG | CTGGGCAGGGCCGGAGTGA |
| 3830 | CACTCCGGCCCTGCCCAGT | ACTGGGCAGGGCCGGAGTG |
| 3831 | ACTCCGGCCCTGCCCAGTG | CACTGGGCAGGGCCGGAGT |
| 3832 | CTCCGGCCCTGCCCAGTGA | TCACTGGGCAGGGCCGGAG |
| 3833 | TCCGGCCCTGCCCAGTGAT | ATCACTGGGCAGGGCCGGA |
| 3834 | CCGGCCCTGCCCAGTGATG | CATCACTGGGCAGGGCCGG |
| 3835 | CGGCCCTGCCCAGTGATGA | TCATCACTGGGCAGGGCCG |
| 3836 | GGCCCTGCCCAGTGATGAC | GTCATCACTGGGCAGGGCC |
| 3837 | GCCCTGCCCAGTGATGACC | GGTCATCACTGGGCAGGGC |
| 3838 | CCCTGCCCAGTGATGACCG | CGGTCATCACTGGGCAGGG |
| 3839 | CCTGCCCAGTGATGACCGC | GCGGTCATCACTGGGCAGG |
| 3840 | CTGCCCAGTGATGACCGCA | TGCGGTCATCACTGGGCAG |
| 3841 | TGCCCAGTGATGACCGCAT | ATGCGGTCATCACTGGGCA |
| 3842 | GCCCAGTGATGACCGCATC | GATGCGGTCATCACTGGGC |
| 3843 | CCCAGTGATGACCGCATCA | TGATGCGGTCATCACTGGG |
| 3844 | CCAGTGATGACCGCATCAC | GTGATGCGGTCATCACTGG |
| 3845 | CAGTGATGACCGCATCACC | GGTGATGCGGTCATCACTG |
| 3846 | AGTGATGACCGCATCACCA | TGGTGATGCGGTCATCACT |
| 3847 | GTGATGACCGCATCACCAA | TTGGTGATGCGGTCATCAC |
| 3848 | TGATGACCGCATCACCAAC | GTTGGTGATGCGGTCATCA |
| 3849 | GATGACCGCATCACCAACA | TGTTGGTGATGCGGTCATC |
| 3850 | ATGACCGCATCACCAACAT | ATGTTGGTGATGCGGTCAT |
| 3851 | TGACCGCATCACCAACATC | GATGTTGGTGATGCGGTCA |
| 3852 | GACCGCATCACCAACATCC | GGATGTTGGTGATGCGGTC |
| 3853 | ACCGCATCACCAACATCCT | AGGATGTTGGTGATGCGGT |
| 3854 | CCGCATCACCAACATCCTG | CAGGATGTTGGTGATGCGG |
| 3855 | CGCATCACCAACATCCTGG | CCAGGATGTTGGTGATGCG |
| 3856 | GCATCACCAACATCCTGGA | TCCAGGATGTTGGTGATGC |
| 3857 | CATCACCAACATCCTGGAC | GTCCAGGATGTTGGTGATG |
| 3858 | ATCACCAACATCCTGGACA | TGTCCAGGATGTTGGTGAT |
| 3859 | TCACCAACATCCTGGACAG | CTGTCCAGGATGTTGGTGA |
| 3860 | CACCAACATCCTGGACAGC | GCTGTCCAGGATGTTGGTG |
| 3861 | ACCAACATCCTGGACAGCA | TGCTGTCCAGGATGTTGGT |
| 3862 | CCAACATCCTGGACAGCAT | ATGCTGTCCAGGATGTTGG |
| 3863 | CAACATCCTGGACAGCATT | AATGCTGTCCAGGATGTTG |
| 3864 | AACATCCTGGACAGCATTA | TAATGCTGTCCAGGATGTT |
| 3865 | ACATCCTGGACAGCATTAT | ATAATGCTGTCCAGGATGT |
| 3866 | CATCCTGGACAGCATTATC | GATAATGCTGTCCAGGATG |
| 3867 | ATCCTGGACAGCATTATCG | CGATAATGCTGTCCAGGAT |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 3868 | TCCTGGACAGCATTATCGC | GCGATAATGCTGTCCAGGA |
| 3869 | CCTGGACAGCATTATCGCA | TGCGATAATGCTGTCCAGG |
| 3870 | CTGGACAGCATTATCGCAC | GTGCGATAATGCTGTCCAG |
| 3871 | TGGACAGCATTATCGCACA | TGTGCGATAATGCTGTCCA |
| 3872 | GGACAGCATTATCGCACAG | CTGTGCGATAATGCTGTCC |
| 3873 | GACAGCATTATCGCACAGG | CCTGTGCGATAATGCTGTC |
| 3874 | ACAGCATTATCGCACAGGT | ACCTGTGCGATAATGCTGT |
| 3875 | CAGCATTATCGCACAGGTG | CACCTGTGCGATAATGCTG |
| 3876 | AGCATTATCGCACAGGTGG | CCACCTGTGCGATAATGCT |
| 3877 | GCATTATCGCACAGGTGGT | ACCACCTGTGCGATAATGC |
| 3878 | CATTATCGCACAGGTGGTG | CACCACCTGTGCGATAATG |
| 3879 | ATTATCGCACAGGTGGTGG | CCACCACCTGTGCGATAAT |
| 3880 | TTATCGCACAGGTGGTGGA | TCCACCACCTGTGCGATAA |
| 3881 | TATCGCACAGGTGGTGGAA | TTCCACCACCTGTGCGATA |
| 3882 | ATCGCACAGGTGGTGGAAC | GTTCCACCACCTGTGCGAT |
| 3883 | TCGCACAGGTGGTGGAACG | CGTTCCACCACCTGTGCGA |
| 3884 | CGCACAGGTGGTGGAACGG | CCGTTCCACCACCTGTGCG |
| 3885 | GCACAGGTGGTGGAACGGA | TCCGTTCCACCACCTGTGC |
| 3886 | CACAGGTGGTGGAACGGAA | TTCCGTTCCACCACCTGTG |
| 3887 | ACAGGTGGTGGAACGGAAG | CTTCCGTTCCACCACCTGT |
| 3888 | CAGGTGGTGGAACGGAAGA | TCTTCCGTTCCACCACCTG |
| 3889 | AGGTGGTGGAACGGAAGAT | ATCTTCCGTTCCACCACCT |
| 3890 | GGTGGTGGAACGGAAGATC | GATCTTCCGTTCCACCACC |
| 3891 | GTGGTGGAACGGAAGATCC | GGATCTTCCGTTCCACCAC |
| 3892 | TGGTGGAACGGAAGATCCA | TGGATCTTCCGTTCCACCA |
| 3893 | GGTGGAACGGAAGATCCAG | CTGGATCTTCCGTTCCACC |
| 3894 | GTGGAACGGAAGATCCAGG | CCTGGATCTTCCGTTCCAC |
| 3895 | TGGAACGGAAGATCCAGGA | TCCTGGATCTTCCGTTCCA |
| 3896 | GGAACGGAAGATCCAGGAG | CTCCTGGATCTTCCGTTCC |
| 3897 | GAACGGAAGATCCAGGAGA | TCTCCTGGATCTTCCGTTC |
| 3898 | AACGGAAGATCCAGGAGAA | TTCTCCTGGATCTTCCGTT |
| 3899 | ACGGAAGATCCAGGAGAAA | TTTCTCCTGGATCTTCCGT |
| 3900 | CGGAAGATCCAGGAGAAAG | CTTTCTCCTGGATCTTCCG |
| 3901 | GGAAGATCCAGGAGAAAGC | GCTTTCTCCTGGATCTTCC |
| 3902 | GAAGATCCAGGAGAAAGCC | GGCTTTCTCCTGGATCTTC |
| 3903 | AAGATCCAGGAGAAAGCCC | GGGCTTTCTCCTGGATCTT |
| 3904 | AGATCCAGGAGAAAGCCCT | AGGGCTTTCTCCTGGATCT |
| 3905 | GATCCAGGAGAAAGCCCTG | CAGGGCTTTCTCCTGGATC |
| 3906 | ATCCAGGAGAAAGCCCTGG | CCAGGGCTTTCTCCTGGAT |
| 3907 | TCCAGGAGAAAGCCCTGGG | CCCAGGGCTTTCTCCTGGA |
| 3908 | CCAGGAGAAAGCCCTGGGG | CCCCAGGGCTTTCTCCTGG |
| 3909 | CAGGAGAAAGCCCTGGGGC | GCCCCAGGGCTTTCTCCTG |
| 3910 | AGGAGAAAGCCCTGGGGCC | GGCCCCAGGGCTTTCTCCT |
| 3911 | GGAGAAAGCCCTGGGGCCG | CGGCCCCAGGGCTTTCTCC |
| 3912 | GAGAAAGCCCTGGGGCCGG | CCGGCCCCAGGGCTTTCTC |
| 3913 | AGAAAGCCCTGGGGCCGGG | CCCGGCCCCAGGGCTTTCT |
| 3914 | GAAAGCCCTGGGGCCGGGG | CCCCGGCCCCAGGGCTTTC |
| 3915 | AAAGCCCTGGGGCCGGGGC | GCCCCGGCCCCAGGGCTTT |
| 3916 | AAGCCCTGGGGCCGGGGCT | AGCCCCGGCCCCAGGGCTT |
| 3917 | AGCCCTGGGGCCGGGGCTT | AAGCCCCGGCCCCAGGGCT |
| 3918 | GCCCTGGGGCCGGGGCTTC | GAAGCCCCGGCCCCAGGGC |
| 3919 | CCCTGGGGCCGGGGCTTCG | CGAAGCCCCGGCCCCAGGG |
| 3920 | CCTGGGGCCGGGGCTTCGA | TCGAAGCCCCGGCCCCAGG |
| 3921 | CTGGGGCCGGGGCTTCGAG | CTCGAAGCCCCGGCCCCAG |
| 3922 | TGGGGCCGGGGCTTCGAGC | GCTCGAAGCCCCGGCCCCA |
| 3923 | GGGGCCGGGGCTTCGAGCT | AGCTCGAAGCCCCGGCCCC |
| 3924 | GGGCCGGGGCTTCGAGCTG | CAGCTCGAAGCCCCGGCCC |
| 3925 | GGCCGGGGCTTCGAGCTGG | CCAGCTCGAAGCCCCGGCC |
| 3926 | GCCGGGGCTTCGAGCTGGC | GCCAGCTCGAAGCCCCGGC |
| 3927 | CCGGGGCTTCGAGCTGGCC | GGCCAGCTCGAAGCCCCGG |
| 3928 | CGGGGCTTCGAGCTGGCCC | GGGCCAGCTCGAAGCCCCG |
| 3929 | GGGGCTTCGAGCTGGCCCG | CGGGCCAGCTCGAAGCCCC |
| 3930 | GGGCTTCGAGCTGGCCCGG | CCGGGCCAGCTCGAAGCCC |
| 3931 | GGCTTCGAGCTGGCCCGGG | CCCGGGCCAGCTCGAAGCC |
| 3932 | GCTTCGAGCTGGCCCGGGT | ACCCGGGCCAGCTCGAAGC |
| 3933 | CTTCGAGCTGGCCCGGGTC | GACCCGGGCCAGCTCGAAG |
| 3934 | TTCGAGCTGGCCCGGGTCT | AGACCCGGGCCAGCTCGAA |
| 3935 | TCGAGCTGGCCCGGGTCTG | CAGACCCGGGCCAGCTCGA |
| 3936 | CGAGCTGGCCCGGGTCTGC | GCAGACCCGGGCCAGCTCG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 3937 | GAGCTGGCCCGGGTCTGCG | CGCAGACCCGGGCCAGCTC |
| 3938 | AGCTGGCCCGGGTCTGCGC | GCGCAGACCCGGGCCAGCT |
| 3939 | GCTGGCCCGGGTCTGCGCA | TGCGCAGACCCGGGCCAGC |
| 3940 | CTGGCCCGGGTCTGCGCAA | TTGCGCAGACCCGGGCCAG |
| 3941 | TGGCCCGGGTCTGCGCAAG | CTTGCGCAGACCCGGGCCA |
| 3942 | GGCCCGGGTCTGCGCAAGG | CCTTGCGCAGACCCGGGCC |
| 3943 | GCCCGGGTCTGCGCAAGGG | CCCTTGCGCAGACCCGGGC |
| 3944 | CCCGGGTCTGCGCAAGGGC | GCCCTTGCGCAGACCCGGG |
| 3945 | CCGGGTCTGCGCAAGGGCC | GGCCCTTGCGCAGACCCGG |
| 3946 | CGGGTCTGCGCAAGGGCCT | AGGCCCTTGCGCAGACCCG |
| 3947 | GGGTCTGCGCAAGGGCCTG | CAGGCCCTTGCGCAGACCC |
| 3948 | GGTCTGCGCAAGGGCCTGG | CCAGGCCCTTGCGCAGACC |
| 3949 | GTCTGCGCAAGGGCCTGGG | CCCAGGCCCTTGCGCAGAC |
| 3950 | TCTGCGCAAGGGCCTGGGC | GCCCAGGCCCTTGCGCAGA |
| 3951 | CTGCGCAAGGGCCTGGGCC | GGCCCAGGCCCTTGCGCAG |
| 3952 | TGCGCAAGGGCCTGGGCCT | AGGCCCAGGCCCTTGCGCA |
| 3953 | GCGCAAGGGCCTGGGCCTG | CAGGCCCAGGCCCTTGCGC |
| 3954 | CGCAAGGGCCTGGGCCTGC | GCAGGCCCAGGCCCTTGCG |
| 3955 | GCAAGGGCCTGGGCCTGCC | GGCAGGCCCAGGCCCTTGC |
| 3956 | CAAGGGCCTGGGCCTGCCC | GGGCAGGCCCAGGCCCTTG |
| 3957 | AAGGGCCTGGGCCTGCCCC | GGGGCAGGCCCAGGCCCTT |
| 3958 | AGGGCCTGGGCCTGCCCCT | AGGGGCAGGCCCAGGCCCT |
| 3959 | GGGCCTGGGCCTGCCCCTC | GAGGGGCAGGCCCAGGCCC |
| 3960 | GGCCTGGGCCTGCCCCTCT | AGAGGGGCAGGCCCAGGCC |
| 3961 | GCCTGGGCCTGCCCCTCTC | GAGAGGGGCAGGCCCAGGC |
| 3962 | CCTGGGCCTGCCCCTCTCT | AGAGAGGGGCAGGCCCAGG |
| 3963 | CTGGGCCTGCCCCTCTCTC | GAGAGAGGGGCAGGCCCAG |
| 3964 | TGGGCCTGCCCCTCTCTCC | GGAGAGAGGGGCAGGCCCA |
| 3965 | GGGCCTGCCCCTCTCTCCA | TGGAGAGAGGGGCAGGCCC |
| 3966 | GGCCTGCCCCTCTCTCCAG | CTGGAGAGAGGGGCAGGCC |
| 3967 | GCCTGCCCCTCTCTCCAGT | ACTGGAGAGAGGGGCAGGC |
| 3968 | CCTGCCCCTCTCTCCAGTG | CACTGGAGAGAGGGGCAGG |
| 3969 | CTGCCCCTCTCTCCAGTGC | GCACTGGAGAGAGGGGCAG |
| 3970 | TGCCCCTCTCTCCAGTGCG | CGCACTGGAGAGAGGGGCA |
| 3971 | GCCCCTCTCTCCAGTGCGG | CCGCACTGGAGAGAGGGGC |
| 3972 | CCCCTCTCTCCAGTGCGGC | GCCGCACTGGAGAGAGGGG |
| 3973 | CCCTCTCTCCAGTGCGGCC | GGCCGCACTGGAGAGAGGG |
| 3974 | CCTCTCTCCAGTGCGGCCC | GGGCCGCACTGGAGAGAGG |
| 3975 | CTCTCTCCAGTGCGGCCCC | GGGGCCGCACTGGAGAGAG |
| 3976 | TCTCTCCAGTGCGGCCCCG | CGGGGCCGCACTGGAGAGA |
| 3977 | CTCTCCAGTGCGGCCCCGG | CCGGGGCCGCACTGGAGAG |
| 3978 | TCTCCAGTGCGGCCCCGGC | GCCGGGGCCGCACTGGAGA |
| 3979 | CTCCAGTGCGGCCCCGGCT | AGCCGGGGCCGCACTGGAG |
| 3980 | TCCAGTGCGGCCCCGGCTG | CAGCCGGGGCCGCACTGGA |
| 3981 | CCAGTGCGGCCCCGGCTGC | GCAGCCGGGGCCGCACTGG |
| 3982 | CAGTGCGGCCCCGGCTGCC | GGCAGCCGGGGCCGCACTG |
| 3983 | AGTGCGGCCCCGGCTGCCT | AGGCAGCCGGGGCCGCACT |
| 3984 | GTGCGGCCCCGGCTGCCTC | GAGGCAGCCGGGGCCGCAC |
| 3985 | TGCGGCCCCGGCTGCCTCC | GGAGGCAGCCGGGGCCGCA |
| 3986 | GCGGCCCCGGCTGCCTCCC | GGGAGGCAGCCGGGGCCGC |
| 3987 | CGGCCCCGGCTGCCTCCCC | GGGGAGGCAGCCGGGGCCG |
| 3988 | GGCCCCGGCTGCCTCCCCC | GGGGGAGGCAGCCGGGGCC |
| 3989 | GCCCCGGCTGCCTCCCCCA | TGGGGGAGGCAGCCGGGGC |
| 3990 | CCCCGGCTGCCTCCCCCAG | CTGGGGGAGGCAGCCGGGG |
| 3991 | CCCGGCTGCCTCCCCCAGG | CCTGGGGGAGGCAGCCGGG |
| 3992 | CCGGCTGCCTCCCCCAGGG | CCCTGGGGGAGGCAGCCGG |
| 3993 | CGGCTGCCTCCCCCAGGGG | CCCCTGGGGGAGGCAGCCG |
| 3994 | GGCTGCCTCCCCCAGGGGC | GCCCCTGGGGGAGGCAGCC |
| 3995 | GCTGCCTCCCCCAGGGGCT | AGCCCCTGGGGGAGGCAGC |
| 3996 | CTGCCTCCCCCAGGGGCTT | AAGCCCCTGGGGGAGGCAG |
| 3997 | TGCCTCCCCCAGGGGCTTT | AAAGCCCCTGGGGGAGGCA |
| 3998 | GCCTCCCCCAGGGGCTTTG | CAAAGCCCCTGGGGGAGGC |
| 3999 | CCTCCCCCAGGGGCTTTGC | GCAAAGCCCCTGGGGGAGG |
| 4000 | CTCCCCCAGGGGCTTTGCT | AGCAAAGCCCCTGGGGGAG |
| 4001 | TCCCCCAGGGGCTTTGCTG | CAGCAAAGCCCCTGGGGGA |
| 4002 | CCCCCAGGGGCTTTGCTGT | ACAGCAAAGCCCCTGGGGG |
| 4003 | CCCCAGGGGCTTTGCTGTG | CACAGCAAAGCCCCTGGGG |
| 4004 | CCCAGGGGCTTTGCTGTGG | CCACAGCAAAGCCCCTGGG |
| 4005 | CCAGGGGCTTTGCTGTGGC | GCCACAGCAAAGCCCCTGG |

TABLE 1-continued cDNA Human Hairless 19-mer Target Sequences and Complement Referenced to NM_005144-
*Homo sapiens* hairless homolog (mouse) (HR), transcript variant 1, complete mRNA (1-5699 bp).
(SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 4006 | CAGGGGCTTTGCTGTGGCT | AGCCACAGCAAAGCCCCTG |
| 4007 | AGGGGCTTTGCTGTGGCTG | CAGCCACAGCAAAGCCCCT |
| 4008 | GGGGCTTTGCTGTGGCTGC | GCAGCCACAGCAAAGCCCC |
| 4009 | GGGCTTTGCTGTGGCTGCA | TGCAGCCACAGCAAAGCCC |
| 4010 | GGCTTTGCTGTGGCTGCAG | CTGCAGCCACAGCAAAGCC |
| 4011 | GCTTTGCTGTGGCTGCAGG | CCTGCAGCCACAGCAAAGC |
| 4012 | CTTTGCTGTGGCTGCAGGA | TCCTGCAGCCACAGCAAAG |
| 4013 | TTTGCTGTGGCTGCAGGAG | CTCCTGCAGCCACAGCAAA |
| 4014 | TTGCTGTGGCTGCAGGAGC | GCTCCTGCAGCCACAGCAA |
| 4015 | TGCTGTGGCTGCAGGAGCC | GGCTCCTGCAGCCACAGCA |
| 4016 | GCTGTGGCTGCAGGAGCCC | GGGCTCCTGCAGCCACAGC |
| 4017 | CTGTGGCTGCAGGAGCCCC | GGGGCTCCTGCAGCCACAG |
| 4018 | TGTGGCTGCAGGAGCCCCA | TGGGGCTCCTGCAGCCACA |
| 4019 | GTGGCTGCAGGAGCCCCAG | CTGGGGCTCCTGCAGCCAC |
| 4020 | TGGCTGCAGGAGCCCCAGC | GCTGGGGCTCCTGCAGCCA |
| 4021 | GGCTGCAGGAGCCCCAGCC | GGCTGGGGCTCCTGCAGCC |
| 4022 | GCTGCAGGAGCCCCAGCCT | AGGCTGGGGCTCCTGCAGC |
| 4023 | CTGCAGGAGCCCCAGCCTT | AAGGCTGGGGCTCCTGCAG |
| 4024 | TGCAGGAGCCCCAGCCTTG | CAAGGCTGGGGCTCCTGCA |
| 4025 | GCAGGAGCCCCAGCCTTGC | GCAAGGCTGGGGCTCCTGC |
| 4026 | CAGGAGCCCCAGCCTTGCC | GGCAAGGCTGGGGCTCCTG |
| 4027 | AGGAGCCCCAGCCTTGCCC | GGGCAAGGCTGGGGCTCCT |
| 4028 | GGAGCCCCAGCCTTGCCCT | AGGGCAAGGCTGGGGCTCC |
| 4029 | GAGCCCCAGCCTTGCCCTC | GAGGGCAAGGCTGGGGCTC |
| 4030 | AGCCCCAGCCTTGCCCTCG | CGAGGGCAAGGCTGGGGCT |
| 4031 | GCCCCAGCCTTGCCCTCGG | CCGAGGGCAAGGCTGGGGC |
| 4032 | CCCCAGCCTTGCCCTCGGC | GCCGAGGGCAAGGCTGGGG |
| 4033 | CCCAGCCTTGCCCTCGGCG | CGCCGAGGGCAAGGCTGGG |
| 4034 | CCAGCCTTGCCCTCGGCGT | ACGCCGAGGGCAAGGCTGG |
| 4035 | CAGCCTTGCCCTCGGCGTG | CACGCCGAGGGCAAGGCTG |
| 4036 | AGCCTTGCCCTCGGCGTGG | CCACGCCGAGGGCAAGGCT |
| 4037 | GCCTTGCCCTCGGCGTGGC | GCCACGCCGAGGGCAAGGC |
| 4038 | CCTTGCCCTCGGCGTGGCT | AGCCACGCCGAGGGCAAGG |
| 4039 | CTTGCCCTCGGCGTGGCTT | AAGCCACGCCGAGGGCAAG |
| 4040 | TTGCCCTCGGCGTGGCTTC | GAAGCCACGCCGAGGGCAA |
| 4041 | TGCCCTCGGCGTGGCTTCC | GGAAGCCACGCCGAGGGCA |
| 4042 | GCCCTCGGCGTGGCTTCCA | TGGAAGCCACGCCGAGGGC |
| 4043 | CCCTCGGCGTGGCTTCCAC | GTGGAAGCCACGCCGAGGG |
| 4044 | CCTCGGCGTGGCTTCCACC | GGTGGAAGCCACGCCGAGG |
| 4045 | CTCGGCGTGGCTTCCACCT | AGGTGGAAGCCACGCCGAG |
| 4046 | TCGGCGTGGCTTCCACCTC | GAGGTGGAAGCCACGCCGA |
| 4047 | CGGCGTGGCTTCCACCTCT | AGAGGTGGAAGCCACGCCG |
| 4048 | GGCGTGGCTTCCACCTCTT | AAGAGGTGGAAGCCACGCC |
| 4049 | GCGTGGCTTCCACCTCTTC | GAAGAGGTGGAAGCCACGC |
| 4050 | CGTGGCTTCCACCTCTTCC | GGAAGAGGTGGAAGCCACG |
| 4051 | GTGGCTTCCACCTCTTCCA | TGGAAGAGGTGGAAGCCAC |
| 4052 | TGGCTTCCACCTCTTCCAG | CTGGAAGAGGTGGAAGCCA |
| 4053 | GGCTTCCACCTCTTCCAGG | CCTGGAAGAGGTGGAAGCC |
| 4054 | GCTTCCACCTCTTCCAGGA | TCCTGGAAGAGGTGGAAGC |
| 4055 | CTTCCACCTCTTCCAGGAG | CTCCTGGAAGAGGTGGAAG |
| 4056 | TTCCACCTCTTCCAGGAGC | GCTCCTGGAAGAGGTGGAA |
| 4057 | TCCACCTCTTCCAGGAGCA | TGCTCCTGGAAGAGGTGGA |
| 4058 | CCACCTCTTCCAGGAGCAC | GTGCTCCTGGAAGAGGTGG |
| 4059 | CACCTCTTCCAGGAGCACT | AGTGCTCCTGGAAGAGGTG |
| 4060 | ACCTCTTCCAGGAGCACTG | CAGTGCTCCTGGAAGAGGT |
| 4061 | CCTCTTCCAGGAGCACTGG | CCAGTGCTCCTGGAAGAGG |
| 4062 | CTCTTCCAGGAGCACTGGA | TCCAGTGCTCCTGGAAGAG |
| 4063 | TCTTCCAGGAGCACTGGAG | CTCCAGTGCTCCTGGAAGA |
| 4064 | CTTCCAGGAGCACTGGAGG | CCTCCAGTGCTCCTGGAAG |
| 4065 | TTCCAGGAGCACTGGAGGC | GCCTCCAGTGCTCCTGGAA |
| 4066 | TCCAGGAGCACTGGAGGCA | TGCCTCCAGTGCTCCTGGA |
| 4067 | CCAGGAGCACTGGAGGCAG | CTGCCTCCAGTGCTCCTGG |
| 4068 | CAGGAGCACTGGAGGCAGG | CCTGCCTCCAGTGCTCCTG |
| 4069 | AGGAGCACTGGAGGCAGGG | CCCTGCCTCCAGTGCTCCT |
| 4070 | GGAGCACTGGAGGCAGGGC | GCCCTGCCTCCAGTGCTCC |
| 4071 | GAGCACTGGAGGCAGGGCC | GGCCCTGCCTCCAGTGCTC |
| 4072 | AGCACTGGAGGCAGGGCCA | TGGCCCTGCCTCCAGTGCT |
| 4073 | GCACTGGAGGCAGGGCCAG | CTGGCCCTGCCTCCAGTGC |
| 4074 | CACTGGAGGCAGGGCCAGC | GCTGGCCCTGCCTCCAGTG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4075 | ACTGGAGGCAGGGCCAGCC | GGCTGGCCCTGCCTCCAGT |
| 4076 | CTGGAGGCAGGGCCAGCCT | AGGCTGGCCCTGCCTCCAG |
| 4077 | TGGAGGCAGGGCCAGCCTG | CAGGCTGGCCCTGCCTCCA |
| 4078 | GGAGGCAGGGCCAGCCTGT | ACAGGCTGGCCCTGCCTCC |
| 4079 | GAGGCAGGGCCAGCCTGTG | CACAGGCTGGCCCTGCCTC |
| 4080 | AGGCAGGGCCAGCCTGTGT | ACACAGGCTGGCCCTGCCT |
| 4081 | GGCAGGGCCAGCCTGTGTT | AACACAGGCTGGCCCTGCC |
| 4082 | GCAGGGCCAGCCTGTGTTG | CAACACAGGCTGGCCCTGC |
| 4083 | CAGGGCCAGCCTGTGTTGG | CCAACACAGGCTGGCCCTG |
| 4084 | AGGGCCAGCCTGTGTTGGT | ACCAACACAGGCTGGCCCT |
| 4085 | GGGCCAGCCTGTGTTGGTG | CACCAACACAGGCTGGCCC |
| 4086 | GGCCAGCCTGTGTTGGTGT | ACACCAACACAGGCTGGCC |
| 4087 | GCCAGCCTGTGTTGGTGTC | GACACCAACACAGGCTGGC |
| 4088 | CCAGCCTGTGTTGGTGTCA | TGACACCAACACAGGCTGG |
| 4089 | CAGCCTGTGTTGGTGTCAG | CTGACACCAACACAGGCTG |
| 4090 | AGCCTGTGTTGGTGTCAGG | CCTGACACCAACACAGGCT |
| 4091 | GCCTGTGTTGGTGTCAGGG | CCCTGACACCAACACAGGC |
| 4092 | CCTGTGTTGGTGTCAGGGA | TCCCTGACACCAACACAGG |
| 4093 | CTGTGTTGGTGTCAGGGAT | ATCCCTGACACCAACACAG |
| 4094 | TGTGTTGGTGTCAGGGATC | GATCCCTGACACCAACACA |
| 4095 | GTGTTGGTGTCAGGGATCC | GGATCCCTGACACCAACAC |
| 4096 | TGTTGGTGTCAGGGATCCA | TGGATCCCTGACACCAACA |
| 4097 | GTTGGTGTCAGGGATCCAA | TTGGATCCCTGACACCAAC |
| 4098 | TTGGTGTCAGGGATCCAAA | TTTGGATCCCTGACACCAA |
| 4099 | TGGTGTCAGGGATCCAAAG | CTTTGGATCCCTGACACCA |
| 4100 | GGTGTCAGGGATCCAAAGG | CCTTTGGATCCCTGACACC |
| 4101 | GTGTCAGGGATCCAAAGGA | TCCTTTGGATCCCTGACAC |
| 4102 | TGTCAGGGATCCAAAGGAC | GTCCTTTGGATCCCTGACA |
| 4103 | GTCAGGGATCCAAAGGACA | TGTCCTTTGGATCCCTGAC |
| 4104 | TCAGGGATCCAAAGGACAT | ATGTCCTTTGGATCCCTGA |
| 4105 | CAGGGATCCAAAGGACATT | AATGTCCTTTGGATCCCTG |
| 4106 | AGGGATCCAAAGGACATTG | CAATGTCCTTTGGATCCCT |
| 4107 | GGGATCCAAAGGACATTGC | GCAATGTCCTTTGGATCCC |
| 4108 | GGATCCAAAGGACATTGCA | TGCAATGTCCTTTGGATCC |
| 4109 | GATCCAAAGGACATTGCAG | CTGCAATGTCCTTTGGATC |
| 4110 | ATCCAAAGGACATTGCAGG | CCTGCAATGTCCTTTGGAT |
| 4111 | TCCAAAGGACATTGCAGGG | CCCTGCAATGTCCTTTGGA |
| 4112 | CCAAAGGACATTGCAGGGC | GCCCTGCAATGTCCTTTGG |
| 4113 | CAAAGGACATTGCAGGGCA | TGCCCTGCAATGTCCTTTG |
| 4114 | AAAGGACATTGCAGGGCAA | TTGCCCTGCAATGTCCTTT |
| 4115 | AAGGACATTGCAGGGCAAC | GTTGCCCTGCAATGTCCTT |
| 4116 | AGGACATTGCAGGGCAACC | GGTTGCCCTGCAATGTCCT |
| 4117 | GGACATTGCAGGGCAACCT | AGGTTGCCCTGCAATGTCC |
| 4118 | GACATTGCAGGGCAACCTG | CAGGTTGCCCTGCAATGTC |
| 4119 | ACATTGCAGGGCAACCTGT | ACAGGTTGCCCTGCAATGT |
| 4120 | CATTGCAGGGCAACCTGTG | CACAGGTTGCCCTGCAATG |
| 4121 | ATTGCAGGGCAACCTGTGG | CCACAGGTTGCCCTGCAAT |
| 4122 | TTGCAGGGCAACCTGTGGG | CCCACAGGTTGCCCTGCAA |
| 4123 | TGCAGGGCAACCTGTGGGG | CCCCACAGGTTGCCCTGCA |
| 4124 | GCAGGGCAACCTGTGGGGG | CCCCCACAGGTTGCCCTGC |
| 4125 | CAGGGCAACCTGTGGGGGA | TCCCCCACAGGTTGCCCTG |
| 4126 | AGGGCAACCTGTGGGGGAC | GTCCCCCACAGGTTGCCCT |
| 4127 | GGGCAACCTGTGGGGGACA | TGTCCCCCACAGGTTGCCC |
| 4128 | GGCAACCTGTGGGGGACAG | CTGTCCCCCACAGGTTGCC |
| 4129 | GCAACCTGTGGGGGACAGA | TCTGTCCCCCACAGGTTGC |
| 4130 | CAACCTGTGGGGGACAGAA | TTCTGTCCCCCACAGGTTG |
| 4131 | AACCTGTGGGGGACAGAAG | CTTCTGTCCCCCACAGGTT |
| 4132 | ACCTGTGGGGGACAGAAGC | GCTTCTGTCCCCCACAGGT |
| 4133 | CCTGTGGGGGACAGAAGCT | AGCTTCTGTCCCCCACAGG |
| 4134 | CTGTGGGGGACAGAAGCTC | GAGCTTCTGTCCCCCACAG |
| 4135 | TGTGGGGGACAGAAGCTCT | AGAGCTTCTGTCCCCCACA |
| 4136 | GTGGGGGACAGAAGCTCTT | AAGAGCTTCTGTCCCCCAC |
| 4137 | TGGGGGACAGAAGCTCTTG | CAAGAGCTTCTGTCCCCCA |
| 4138 | GGGGGACAGAAGCTCTTGG | CCAAGAGCTTCTGTCCCCC |
| 4139 | GGGGACAGAAGCTCTTGGG | CCCAAGAGCTTCTGTCCCC |
| 4140 | GGGACAGAAGCTCTTGGGG | CCCCAAGAGCTTCTGTCCC |
| 4141 | GGACAGAAGCTCTTGGGGC | GCCCCAAGAGCTTCTGTCC |
| 4142 | GACAGAAGCTCTTGGGGCA | TGCCCCAAGAGCTTCTGTC |
| 4143 | ACAGAAGCTCTTGGGGCAC | GTGCCCCAAGAGCTTCTGT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4144 | CAGAAGCTCTTGGGGCACT | AGTGCCCCAAGAGCTTCTG |
| 4145 | AGAAGCTGTTGGGGCACTT | AAGTGCCCCAAGAGCTTCT |
| 4146 | GAAGCTCTTGGGGCACTTG | CAAGTGCCCCAAGAGCTTC |
| 4147 | AAGCTCTTGGGGCACTTGG | CCAAGTGCCCCAAGAGCTT |
| 4148 | AGCTCTTGGGGCACTTGGA | TCCAAGTGCCCCAAGAGCT |
| 4149 | GCTCTTGGGGCACTTGGAG | CTCCAAGTGCCCCAAGAGC |
| 4150 | CTCTTGGGGCACTTGGAGG | CCTCCAAGTGCCCCAAGAG |
| 4151 | TCTTGGGGCACTTGGAGGC | GCCTCCAAGTGCCCCAAGA |
| 4152 | CTTGGGGCACTTGGAGGCC | GGCCTCCAAGTGCCCCAAG |
| 4153 | TTGGGGCACTTGGAGGCCA | TGGCCTCCAAGTGCCCCAA |
| 4154 | TGGGGCACTTGGAGGCCAG | CTGGCCTCCAAGTGCCCCA |
| 4155 | GGGGCACTTGGAGGCCAGG | CCTGGCCTCCAAGTGCCCC |
| 4156 | GGGCACTTGGAGGCCAGGT | ACCTGGCCTCCAAGTGCCC |
| 4157 | GGCACTTGGAGGCCAGGTG | CACCTGGCCTCCAAGTGCC |
| 4158 | GCACTTGGAGGCCAGGTGC | GCACCTGGCCTCCAAGTGC |
| 4159 | CACTTGGAGGCCAGGTGCA | TGCACCTGGCCTCCAAGTG |
| 4160 | ACTTGGAGGCCAGGTGCAG | CTGCACCTGGCCTCCAAGT |
| 4161 | CTTGGAGGCCAGGTGCAGG | CCTGCACCTGGCCTCCAAG |
| 4162 | TTGGAGGCCAGGTGCAGGC | GCCTGCACCTGGCCTCCAA |
| 4163 | TGGAGGCCAGGTGCAGGCG | CGCCTGCACCTGGCCTCCA |
| 4164 | GGAGGCCAGGTGCAGGCGC | GCGCCTGCACCTGGCCTCC |
| 4165 | GAGGCCAGGTGCAGGCGCT | AGCGCCTGCACCTGGCCTC |
| 4166 | AGGCCAGGTGCAGGCGCTG | CAGCGCCTGCACCTGGCCT |
| 4167 | GGCCAGGTGCAGGCGCTGA | TCAGCGCCTGCACCTGGCC |
| 4168 | GCCAGGTGCAGGCGCTGAG | CTCAGCGCCTGCACCTGGC |
| 4169 | CCAGGTGCAGGCGCTGAGC | GCTCAGCGCCTGCACCTGG |
| 4170 | CAGGTGCAGGCGCTGAGCC | GGCTCAGCGCCTGCACCTG |
| 4171 | AGGTGCAGGCGCTGAGCCC | GGGCTCAGCGCCTGCACCT |
| 4172 | GGTGCAGGCGCTGAGCCCC | GGGGCTCAGCGCCTGCACC |
| 4173 | GTGCAGGCGCTGAGCCCCC | GGGGGCTCAGCGCCTGCAC |
| 4174 | TGCAGGCGCTGAGCCCCCT | AGGGGGCTCAGCGCCTGCA |
| 4175 | GCAGGCGCTGAGCCCCCTC | GAGGGGGCTCAGCGCCTGC |
| 4176 | CAGGCGCTGAGCCCCCTCG | CGAGGGGGCTCAGCGCCTG |
| 4177 | AGGCGCTGAGCCCCCTCGG | CCGAGGGGGCTCAGCGCCT |
| 4178 | GGCGCTGAGCCCCCTCGGA | TCCGAGGGGGCTCAGCGCC |
| 4179 | GCGCTGAGCCCCCTCGGAC | GTCCGAGGGGGCTCAGCGC |
| 4180 | CGCTGAGCCCCCTCGGACC | GGTCCGAGGGGGCTCAGCG |
| 4181 | GCTGAGCCCCCTCGGACCT | AGGTCCGAGGGGGCTCAGC |
| 4182 | CTGAGCCCCCTCGGACCTC | GAGGTCCGAGGGGGCTCAG |
| 4183 | TGAGCCCCCTCGGACCTCC | GGAGGTCCGAGGGGGCTCA |
| 4184 | GAGCCCCCTCGGACCTCCC | GGGAGGTCCGAGGGGGCTC |
| 4185 | AGCCCCCTCGGACCTCCCC | GGGGAGGTCCGAGGGGGCT |
| 4186 | GCCCCCTCGGACCTCCCCA | TGGGGAGGTCCGAGGGGGC |
| 4187 | CCCCCTCGGACCTCCCCAG | CTGGGGAGGTCCGAGGGGG |
| 4188 | CCCCTCGGACCTCCCCAGC | GCTGGGGAGGTCCGAGGGG |
| 4189 | CCCTCGGACCTCCCCAGCC | GGCTGGGGAGGTCCGAGGG |
| 4190 | CCTCGGACCTCCCCAGCCC | GGGCTGGGGAGGTCCGAGG |
| 4191 | CTCGGACCTCCCCAGCCCA | TGGGCTGGGGAGGTCCGAG |
| 4192 | TCGGACCTCCCCAGCCCAG | CTGGGCTGGGGAGGTCCGA |
| 4193 | CGGACCTCCCCAGCCCAGC | GCTGGGCTGGGGAGGTCCG |
| 4194 | GGACCTCCCCAGCCCAGCA | TGCTGGGCTGGGGAGGTCC |
| 4195 | GACCTCCCCAGCCCAGCAG | CTGCTGGGCTGGGGAGGTC |
| 4196 | ACCTCCCCAGCCCAGCAGC | GCTGCTGGGCTGGGGAGGT |
| 4197 | CCTCCCCAGCCCAGCAGCC | GGCTGCTGGGCTGGGGAGG |
| 4198 | CTCCCCAGCCCAGCAGCCT | AGGCTGCTGGGCTGGGGAG |
| 4199 | TCCCCAGCCCAGCAGCCTG | CAGGCTGCTGGGCTGGGGA |
| 4200 | CCCCAGCCCAGCAGCCTGG | CCAGGCTGCTGGGCTGGGG |
| 4201 | CCCAGCCCAGCAGCCTGGG | CCCAGGCTGCTGGGCTGGG |
| 4202 | CCAGCCCAGCAGCCTGGGC | GCCCAGGCTGCTGGGCTGG |
| 4203 | CAGCCCAGCAGCCTGGGCA | TGCCCAGGCTGCTGGGCTG |
| 4204 | AGCCCAGCAGCCTGGGCAG | CTGCCCAGGCTGCTGGGCT |
| 4205 | GCCCAGCAGCCTGGGCAGC | GCTGCCCAGGCTGCTGGGC |
| 4206 | CCCAGCAGCCTGGGCAGCA | TGCTGCCCAGGCTGCTGGG |
| 4207 | CCAGCAGCCTGGGCAGCAC | GTGCTGCCCAGGCTGCTGG |
| 4208 | CAGCAGCCTGGGCAGCACA | TGTGCTGCCCAGGCTGCTG |
| 4209 | AGCAGCCTGGGCAGCACAA | TTGTGCTGCCCAGGCTGCT |
| 4210 | GCAGCCTGGGCAGCACAAC | GTTGTGCTGCCCAGGCTGC |
| 4211 | CAGCCTGGGCAGCACAACA | TGTTGTGCTGCCCAGGCTG |
| 4212 | AGCCTGGGCAGCACAACAT | ATGTTGTGCTGCCCAGGCT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4213 | GCCTGGGCAGCACAACATT | AATGTTGTGCTGCCCAGGC |
| 4214 | CCTGGGCAGCACAACATTC | GAATGTTGTGCTGCCCAGG |
| 4215 | CTGGGCAGCACAACATTCT | AGAATGTTGTGCTGCCCAG |
| 4216 | TGGGCAGCACAACATTCTG | CAGAATGTTGTGCTGCCCA |
| 4217 | GGGCAGCACAACATTCTGG | CCAGAATGTTGTGCTGCCC |
| 4218 | GGCAGCACAACATTCTGGG | CCCAGAATGTTGTGCTGCC |
| 4219 | GCAGCACAACATTCTGGGA | TCCCAGAATGTTGTGCTGC |
| 4220 | CAGCACAACATTCTGGGAG | CTCCCAGAATGTTGTGCTG |
| 4221 | AGCACAACATTCTGGGAGG | CCTCCCAGAATGTTGTGCT |
| 4222 | GCACAACATTCTGGGAGGG | CCCTCCCAGAATGTTGTGC |
| 4223 | CACAACATTCTGGGAGGGC | GCCCTCCCAGAATGTTGTG |
| 4224 | ACAACATTCTGGGAGGGCT | AGCCCTCCCAGAATGTTGT |
| 4225 | CAACATTCTGGGAGGGCTT | AAGCCCTCCCAGAATGTTG |
| 4226 | AACATTCTGGGAGGGCTTC | GAAGCCCTCCCAGAATGTT |
| 4227 | ACATTCTGGGAGGGCTTCT | AGAAGCCCTCCCAGAATGT |
| 4228 | CATTCTGGGAGGGCTTCTC | GAGAAGCCCTCCCAGAATG |
| 4229 | ATTCTGGGAGGGCTTCTCC | GGAGAAGCCCTCCCAGAAT |
| 4230 | TTCTGGGAGGGCTTCTCCT | AGGAGAAGCCCTCCCAGAA |
| 4231 | TCTGGGAGGGCTTCTCCTG | CAGGAGAAGCCCTCCCAGA |
| 4232 | CTGGGAGGGCTTCTCCTGG | CCAGGAGAAGCCCTCCCAG |
| 4233 | TGGGAGGGCTTCTCCTGGC | GCCAGGAGAAGCCCTCCCA |
| 4234 | GGGAGGGCTTCTCCTGGCC | GGCCAGGAGAAGCCCTCCC |
| 4235 | GGAGGGCTTCTCCTGGCCT | AGGCCAGGAGAAGCCCTCC |
| 4236 | GAGGGCTTCTCCTGGCCTG | CAGGCCAGGAGAAGCCCTC |
| 4237 | AGGGCTTCTCCTGGCCTGA | TCAGGCCAGGAGAAGCCCT |
| 4238 | GGGCTTCTCCTGGCCTGAG | CTCAGGCCAGGAGAAGCCC |
| 4239 | GGCTTCTCCTGGCCTGAGC | GCTCAGGCCAGGAGAAGCC |
| 4240 | GCTTCTCCTGGCCTGAGCT | AGCTCAGGCCAGGAGAAGC |
| 4241 | CTTCTCCTGGCCTGAGCTT | AAGCTCAGGCCAGGAGAAG |
| 4242 | TTCTCCTGGCCTGAGCTTC | GAAGCTCAGGCCAGGAGAA |
| 4243 | TCTCCTGGCCTGAGCTTCG | CGAAGCTCAGGCCAGGAGA |
| 4244 | CTCCTGGCCTGAGCTTCGC | GCGAAGCTCAGGCCAGGAG |
| 4245 | TCCTGGCCTGAGCTTCGCC | GGCGAAGCTCAGGCCAGGA |
| 4246 | CCTGGCCTGAGCTTCGCCC | GGGCGAAGCTCAGGCCAGG |
| 4247 | CTGGCCTGAGCTTCGCCCA | TGGGCGAAGCTCAGGCCAG |
| 4248 | TGGCCTGAGCTTCGCCCAA | TTGGGCGAAGCTCAGGCCA |
| 4249 | GGCCTGAGCTTCGCCCAAA | TTTGGGCGAAGCTCAGGCC |
| 4250 | GCCTGAGCTTCGCCCAAAG | CTTTGGGCGAAGCTCAGGC |
| 4251 | CCTGAGCTTCGCCCAAAGT | ACTTTGGGCGAAGCTCAGG |
| 4252 | CTGAGCTTCGCCCAAAGTC | GACTTTGGGCGAAGCTCAG |
| 4253 | TGAGCTTCGCCCAAAGTCA | TGACTTTGGGCGAAGCTCA |
| 4254 | GAGCTTCGCCCAAAGTCAG | CTGACTTTGGGCGAAGCTC |
| 4255 | AGCTTCGCCCAAAGTCAGA | TCTGACTTTGGGCGAAGCT |
| 4256 | GCTTCGCCCAAAGTCAGAC | GTCTGACTTTGGGCGAAGC |
| 4257 | CTTCGCCCAAAGTCAGACG | CGTCTGACTTTGGGCGAAG |
| 4258 | TTCGCCCAAAGTCAGACGA | TCGTCTGACTTTGGGCGAA |
| 4259 | TCGCCCAAAGTCAGACGAG | CTCGTCTGACTTTGGGCGA |
| 4260 | CGCCCAAAGTCAGACGAGG | CCTCGTCTGACTTTGGGCG |
| 4261 | GCCCAAAGTCAGACGAGGG | CCCTCGTCTGACTTTGGGC |
| 4262 | CCCAAAGTCAGACGAGGGC | GCCCTCGTCTGACTTTGGG |
| 4263 | CCAAAGTCAGACGAGGGCT | AGCCCTCGTCTGACTTTGG |
| 4264 | CAAAGTCAGACGAGGGCTC | GAGCCCTCGTCTGACTTTG |
| 4265 | AAAGTCAGACGAGGGCTCT | AGAGCCCTCGTCTGACTTT |
| 4266 | AAGTCAGACGAGGGCTCTG | CAGAGCCCTCGTCTGACTT |
| 4267 | AGTCAGACGAGGGCTCTGT | ACAGAGCCCTCGTCTGACT |
| 4268 | GTCAGACGAGGGCTCTGTC | GACAGAGCCCTCGTCTGAC |
| 4269 | TCAGACGAGGGCTCTGTCC | GGACAGAGCCCTCGTCTGA |
| 4270 | CAGACGAGGGCTCTGTCCT | AGGACAGAGCCCTCGTCTG |
| 4271 | AGACGAGGGCTCTGTCCTC | GAGGACAGAGCCCTCGTCT |
| 4272 | GACGAGGGCTCTGTCCTCC | GGAGGACAGAGCCCTCGTC |
| 4273 | ACGAGGGCTCTGTCCTCCT | AGGAGGACAGAGCCCTCGT |
| 4274 | CGAGGGCTCTGTCCTCCTG | CAGGAGGACAGAGCCCTCG |
| 4275 | GAGGGCTCTGTCCTCCTGC | GCAGGAGGACAGAGCCCTC |
| 4276 | AGGGCTCTGTCCTCCTGCT | AGCAGGAGGACAGAGCCCT |
| 4277 | GGGCTCTGTCCTCCTGCTG | CAGCAGGAGGACAGAGCCC |
| 4278 | GGCTCTGTCCTCCTGCTGC | GCAGCAGGAGGACAGAGCC |
| 4279 | GCTCTGTCCTCCTGCTGCA | TGCAGCAGGAGGACAGAGC |
| 4280 | CTCTGTCCTCCTGCTGCAC | GTGCAGCAGGAGGACAGAG |
| 4281 | TCTGTCCTCCTGCTGCACC | GGTGCAGCAGGAGGACAGA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4282 | CTGTCCTCCTGCTGCACCG | CGGTGCAGCAGGAGGACAG |
| 4283 | TGTCCTCCTGCTGCACCGA | TCGGTGCAGCAGGAGGACA |
| 4284 | GTCCTCCTGCTGCACCGAG | CTCGGTGCAGCAGGAGGAC |
| 4285 | TCCTCCTGCTGCACCGAGC | GCTCGGTGCAGCAGGAGGA |
| 4286 | CCTCCTGCTGCACCGAGCT | AGCTCGGTGCAGCAGGAGG |
| 4287 | CTCCTGCTGCACCGAGCTT | AAGCTCGGTGCAGCAGGAG |
| 4288 | TCCTGCTGCACCGAGCTTT | AAAGCTCGGTGCAGCAGGA |
| 4289 | CCTGCTGCACCGAGCTTTG | CAAAGCTCGGTGCAGCAGG |
| 4290 | CTGCTGCACCGAGCTTTGG | CCAAAGCTCGGTGCAGCAG |
| 4291 | TGCTGCACCGAGCTTTGGG | CCCAAAGCTCGGTGCAGCA |
| 4292 | GCTGCACCGAGCTTTGGGG | CCCCAAAGCTCGGTGCAGC |
| 4293 | CTGCACCGAGCTTTGGGGG | CCCCCAAAGCTCGGTGCAG |
| 4294 | TGCACCGAGCTTTGGGGGA | TCCCCCAAAGCTCGGTGCA |
| 4295 | GCACCGAGCTTTGGGGGAT | ATCCCCCAAAGCTCGGTGC |
| 4296 | CACCGAGCTTTGGGGGATG | CATCCCCCAAAGCTCGGTG |
| 4297 | ACCGAGCTTTGGGGGATGA | TCATCCCCCAAAGCTCGGT |
| 4298 | CCGAGCTTTGGGGGATGAG | CTCATCCCCCAAAGCTCGG |
| 4299 | CGAGCTTTGGGGGATGAGG | CCTCATCCCCCAAAGCTCG |
| 4300 | GAGCTTTGGGGGATGAGGA | TCCTCATCCCCCAAAGCTC |
| 4301 | AGCTTTGGGGGATGAGGAC | GTCCTCATCCCCCAAAGCT |
| 4302 | GCTTTGGGGGATGAGGACA | TGTCCTCATCCCCCAAAGC |
| 4303 | CTTTGGGGGATGAGGACAC | GTGTCCTCATCCCCCAAAG |
| 4304 | TTTGGGGGATGAGGACACC | GGTGTCCTCATCCCCCAAA |
| 4305 | TTGGGGGATGAGGACACCA | TGGTGTCCTCATCCCCCAA |
| 4306 | TGGGGGATGAGGACACCAG | CTGGTGTCCTCATCCCCCA |
| 4307 | GGGGGATGAGGACACCAGC | GCTGGTGTCCTCATCCCCC |
| 4308 | GGGGATGAGGACACCAGCA | TGCTGGTGTCCTCATCCCC |
| 4309 | GGGATGAGGACACCAGCAG | CTGCTGGTGTCCTCATCCC |
| 4310 | GGATGAGGACACCAGCAGG | CCTGCTGGTGTCCTCATCC |
| 4311 | GATGAGGACACCAGCAGGG | CCCTGCTGGTGTCCTCATC |
| 4312 | ATGAGGACACCAGCAGGGT | ACCCTGCTGGTGTCCTCAT |
| 4313 | TGAGGACACCAGCAGGGTG | CACCCTGCTGGTGTCCTCA |
| 4314 | GAGGACACCAGCAGGGTGG | CCACCCTGCTGGTGTCCTC |
| 4315 | AGGACACCAGCAGGGTGGA | TCCACCCTGCTGGTGTCCT |
| 4316 | GGACACCAGCAGGGTGGAG | CTCCACCCTGCTGGTGTCC |
| 4317 | GACACCAGCAGGGTGGAGA | TCTCCACCCTGCTGGTGTC |
| 4318 | ACACCAGCAGGGTGGAGAA | TTCTCCACCCTGCTGGTGT |
| 4319 | CACCAGCAGGGTGGAGAAC | GTTCTCCACCCTGCTGGTG |
| 4320 | ACCAGCAGGGTGGAGAACC | GGTTCTCCACCCTGCTGGT |
| 4321 | CCAGCAGGGTGGAGAACCT | AGGTTCTCCACCCTGCTGG |
| 4322 | CAGCAGGGTGGAGAACCTA | TAGGTTCTCCACCCTGCTG |
| 4323 | AGCAGGGTGGAGAACCTAG | CTAGGTTCTCCACCCTGCT |
| 4324 | GCAGGGTGGAGAACCTAGC | GCTAGGTTCTCCACCCTGC |
| 4325 | CAGGGTGGAGAACCTAGCT | AGCTAGGTTCTCCACCCTG |
| 4326 | AGGGTGGAGAACCTAGCTG | CAGCTAGGTTCTCCACCCT |
| 4327 | GGGTGGAGAACCTAGCTGC | GCAGCTAGGTTCTCCACCC |
| 4328 | GGTGGAGAACCTAGCTGCC | GGCAGCTAGGTTCTCCACC |
| 4329 | GTGGAGAACCTAGCTGCCA | TGGCAGCTAGGTTCTCCAC |
| 4330 | TGGAGAACCTAGCTGCCAG | CTGGCAGCTAGGTTCTCCA |
| 4331 | GGAGAACCTAGCTGCCAGT | ACTGGCAGCTAGGTTCTCC |
| 4332 | GAGAACCTAGCTGCCAGTC | GACTGGCAGCTAGGTTCTC |
| 4333 | AGAACCTAGCTGCCAGTCT | AGACTGGCAGCTAGGTTCT |
| 4334 | GAACCTAGCTGCCAGTCTG | CAGACTGGCAGCTAGGTTC |
| 4335 | AACCTAGCTGCCAGTCTGC | GCAGACTGGCAGCTAGGTT |
| 4336 | ACCTAGCTGCCAGTCTGCC | GGCAGACTGGCAGCTAGGT |
| 4337 | CCTAGCTGCCAGTCTGCCA | TGGCAGACTGGCAGCTAGG |
| 4338 | CTAGCTGCCAGTCTGCCAC | GTGGCAGACTGGCAGCTAG |
| 4339 | TAGCTGCCAGTCTGCCACT | AGTGGCAGACTGGCAGCTA |
| 4340 | AGCTGCCAGTCTGCCACTT | AAGTGGCAGACTGGCAGCT |
| 4341 | GCTGCCAGTCTGCCACTTC | GAAGTGGCAGACTGGCAGC |
| 4342 | CTGCCAGTCTGCCACTTCC | GGAAGTGGCAGACTGGCAG |
| 4343 | TGCCAGTCTGCCACTTCCG | CGGAAGTGGCAGACTGGCA |
| 4344 | GCCAGTCTGCCACTTCCGG | CCGGAAGTGGCAGACTGGC |
| 4345 | CCAGTCTGCCACTTCCGGA | TCCGGAAGTGGCAGACTGG |
| 4346 | CAGTCTGCCACTTCCGGAG | CTCCGGAAGTGGCAGACTG |
| 4347 | AGTCTGCCACTTCCGGAGT | ACTCCGGAAGTGGCAGACT |
| 4348 | GTCTGCCACTTCCGGAGTA | TACTCCGGAAGTGGCAGAC |
| 4349 | TCTGCCACTTCCGGAGTAC | GTACTCCGGAAGTGGCAGA |
| 4350 | CTGCCACTTCCGGAGTACT | AGTACTCCGGAAGTGGCAG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4351 | TGCCACTTCCGGAGTACTG | CAGTACTCCGGAAGTGGCA |
| 4352 | GCCACTTCCGGAGTACTGC | GCAGTACTCCGGAAGTGGC |
| 4353 | CCACTTCCGGAGTACTGCG | CGCAGTACTCCGGAAGTGG |
| 4354 | CACTTCCGGAGTACTGCGC | GCGCAGTACTCCGGAAGTG |
| 4355 | ACTTCCGGAGTACTGCGCC | GGCGCAGTACTCCGGAAGT |
| 4356 | CTTCCGGAGTACTGCGCCC | GGGCGCAGTACTCCGGAAG |
| 4357 | TTCCGGAGTACTGCGCCCT | AGGGCGCAGTACTCCGGAA |
| 4358 | TCCGGAGTACTGCGCCCTC | GAGGGCGCAGTACTCCGGA |
| 4359 | CCGGAGTACTGCGCCCTCC | GGAGGGCGCAGTACTCCGG |
| 4360 | CGGAGTACTGCGCCCTCCA | TGGAGGGCGCAGTACTCCG |
| 4361 | GGAGTACTGCGCCCTCCAT | ATGGAGGGCGCAGTACTCC |
| 4362 | GAGTACTGCGCCCTCCATG | CATGGAGGGCGCAGTACTC |
| 4363 | AGTACTGCGCCCTCCATGG | CCATGGAGGGCGCAGTACT |
| 4364 | GTACTGCGCCCTCCATGGA | TCCATGGAGGGCGCAGTAC |
| 4365 | TACTGCGCCCTCCATGGAA | TTCCATGGAGGGCGCAGTA |
| 4366 | ACTGCGCCCTCCATGGAAA | TTTCCATGGAGGGCGCAGT |
| 4367 | CTGCGCCCTCCATGGAAAA | TTTTCCATGGAGGGCGCAG |
| 4368 | TGCGCCCTCCATGGAAAAC | GTTTTCCATGGAGGGCGCA |
| 4369 | GCGCCCTCCATGGAAAACT | AGTTTTCCATGGAGGGCGC |
| 4370 | CGCCCTCCATGGAAAACTC | GAGTTTTCCATGGAGGGCG |
| 4371 | GCCCTCCATGGAAAACTCA | TGAGTTTTCCATGGAGGGC |
| 4372 | CCCTCCATGGAAAACTCAA | TTGAGTTTTCCATGGAGGG |
| 4373 | CCTCCATGGAAAACTCAAC | GTTGAGTTTTCCATGGAGG |
| 4374 | CTCCATGGAAAACTCAACC | GGTTGAGTTTTCCATGGAG |
| 4375 | TCCATGGAAAACTCAACCT | AGGTTGAGTTTTCCATGGA |
| 4376 | CCATGGAAAACTCAACCTG | CAGGTTGAGTTTTCCATGG |
| 4377 | CATGGAAAACTCAACCTGG | CCAGGTTGAGTTTTCCATG |
| 4378 | ATGGAAAACTCAACCTGGC | GCCAGGTTGAGTTTTCCAT |
| 4379 | TGGAAAACTCAACCTGGCT | AGCCAGGTTGAGTTTTCCA |
| 4380 | GGAAAACTCAACCTGGCTT | AAGCCAGGTTGAGTTTTCC |
| 4381 | GAAAACTCAACCTGGCTTC | GAAGCCAGGTTGAGTTTTC |
| 4382 | AAAACTCAACCTGGCTTCC | GGAAGCCAGGTTGAGTTTT |
| 4383 | AAACTCAACCTGGCTTCCT | AGGAAGCCAGGTTGAGTTT |
| 4384 | AACTCAACCTGGCTTCCTA | TAGGAAGCCAGGTTGAGTT |
| 4385 | ACTCAACCTGGCTTCCTAC | GTAGGAAGCCAGGTTGAGT |
| 4386 | CTCAACCTGGCTTCCTACC | GGTAGGAAGCCAGGTTGAG |
| 4387 | TCAACCTGGCTTCCTACCT | AGGTAGGAAGCCAGGTTGA |
| 4388 | CAACCTGGCTTCCTACCTC | GAGGTAGGAAGCCAGGTTG |
| 4389 | AACCTGGCTTCCTACCTCC | GGAGGTAGGAAGCCAGGTT |
| 4390 | ACCTGGCTTCCTACCTCCC | GGGAGGTAGGAAGCCAGGT |
| 4391 | CCTGGCTTCCTACCTCCCA | TGGGAGGTAGGAAGCCAGG |
| 4392 | CTGGCTTCCTACCTCCCAC | GTGGGAGGTAGGAAGCCAG |
| 4393 | TGGCTTCCTACCTCCCACC | GGTGGGAGGTAGGAAGCCA |
| 4394 | GGCTTCCTACCTCCCACCG | CGGTGGGAGGTAGGAAGCC |
| 4395 | GCTTCCTACCTCCCACCGG | CCGGTGGGAGGTAGGAAGC |
| 4396 | CTTCCTACCTCCCACCGGG | CCCGGTGGGAGGTAGGAAG |
| 4397 | TTCCTACCTCCCACCGGGC | GCCCGGTGGGAGGTAGGAA |
| 4398 | TCCTACCTCCCACCGGGCC | GGCCCGGTGGGAGGTAGGA |
| 4399 | CCTACCTCCCACCGGGCCT | AGGCCCGGTGGGAGGTAGG |
| 4400 | CTACCTCCCACCGGGCCTT | AAGGCCCGGTGGGAGGTAG |
| 4401 | TACCTCCCACCGGGCCTTG | CAAGGCCCGGTGGGAGGTA |
| 4402 | ACCTCCCACCGGGCCTTGC | GCAAGGCCCGGTGGGAGGT |
| 4403 | CCTCCCACCGGGCCTTGCC | GGCAAGGCCCGGTGGGAGG |
| 4404 | CTCCCACCGGGCCTTGCCC | GGGCAAGGCCCGGTGGGAG |
| 4405 | TCCCACCGGGCCTTGCCCT | AGGGCAAGGCCCGGTGGGA |
| 4406 | CCCACCGGGCCTTGCCCTG | CAGGGCAAGGCCCGGTGGG |
| 4407 | CCACCGGGCCTTGCCCTGC | GCAGGGCAAGGCCCGGTGG |
| 4408 | CACCGGGCCTTGCCCTGCG | CGCAGGGCAAGGCCCGGTG |
| 4409 | ACCGGGCCTTGCCCTGCGT | ACGCAGGGCAAGGCCCGGT |
| 4410 | CCGGGCCTTGCCCTGCGTC | GACGCAGGGCAAGGCCCGG |
| 4411 | CGGGCCTTGCCCTGCGTCC | GGACGCAGGGCAAGGCCCG |
| 4412 | GGGCCTTGCCCTGCGTCCA | TGGACGCAGGGCAAGGCCC |
| 4413 | GGCCTTGCCCTGCGTCCAC | GTGGACGCAGGGCAAGGCC |
| 4414 | GCCTTGCCCTGCGTCCACT | AGTGGACGCAGGGCAAGGC |
| 4415 | CCTTGCCCTGCGTCCACTG | CAGTGGACGCAGGGCAAGG |
| 4416 | CTTGCCCTGCGTCCACTGG | CCAGTGGACGCAGGGCAAG |
| 4417 | TTGCCCTGCGTCCACTGGA | TCCAGTGGACGCAGGGCAA |
| 4418 | TGCCCTGCGTCCACTGGAG | CTCCAGTGGACGCAGGGCA |
| 4419 | GCCCTGCGTCCACTGGAGC | GCTCCAGTGGACGCAGGGC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4420 | CCCTGCGTCCACTGGAGCC | GGCTCCAGTGGACGCAGGG |
| 4421 | CCTGCGTCCACTGGAGCCC | GGGCTCCAGTGGACGCAGG |
| 4422 | CTGCGTCCACTGGAGCCCC | GGGGCTCCAGTGGACGCAG |
| 4423 | TGCGTCCACTGGAGCCCCA | TGGGGCTCCAGTGGACGCA |
| 4424 | GCGTCCACTGGAGCCCCAG | CTGGGGCTCCAGTGGACGC |
| 4425 | CGTCCACTGGAGCCCCAGC | GCTGGGGCTCCAGTGGACG |
| 4426 | GTCCACTGGAGCCCCAGCT | AGCTGGGGCTCCAGTGGAC |
| 4427 | TCCACTGGAGCCCCAGCTC | GAGCTGGGGCTCCAGTGGA |
| 4428 | CCACTGGAGCCCCAGCTCT | AGAGCTGGGGCTCCAGTGG |
| 4429 | CACTGGAGCCCCAGCTCTG | CAGAGCTGGGGCTCCAGTG |
| 4430 | ACTGGAGCCCCAGCTCTGG | CCAGAGCTGGGGCTCCAGT |
| 4431 | CTGGAGCCCCAGCTCTGGG | CCCAGAGCTGGGGCTCCAG |
| 4432 | TGGAGCCCCAGCTCTGGGC | GCCCAGAGCTGGGGCTCCA |
| 4433 | GGAGCCCCAGCTCTGGGCA | TGCCCAGAGCTGGGGCTCC |
| 4434 | GAGCCCCAGCTCTGGGCAG | CTGCCCAGAGCTGGGGCTC |
| 4435 | AGCCCCAGCTCTGGGCAGC | GCTGCCCAGAGCTGGGGCT |
| 4436 | GCCCCAGCTCTGGGCAGCC | GGCTGCCCAGAGCTGGGGC |
| 4437 | CCCCAGCTCTGGGCAGCCT | AGGCTGCCCAGAGCTGGGG |
| 4438 | CCCAGCTCTGGGCAGCCTA | TAGGCTGCCCAGAGCTGGG |
| 4439 | CCAGCTCTGGGCAGCCTAT | ATAGGCTGCCCAGAGCTGG |
| 4440 | CAGCTCTGGGCAGCCTATG | CATAGGCTGCCCAGAGCTG |
| 4441 | AGCTCTGGGCAGCCTATGG | CCATAGGCTGCCCAGAGCT |
| 4442 | GCTCTGGGCAGCCTATGGT | ACCATAGGCTGCCCAGAGC |
| 4443 | CTCTGGGCAGCCTATGGTG | CACCATAGGCTGCCCAGAG |
| 4444 | TCTGGGCAGCCTATGGTGT | ACACCATAGGCTGCCCAGA |
| 4445 | CTGGGCAGCCTATGGTGTG | CACACCATAGGCTGCCCAG |
| 4446 | TGGGCAGCCTATGGTGTGA | TCACACCATAGGCTGCCCA |
| 4447 | GGGCAGCCTATGGTGTGAG | CTCACACCATAGGCTGCCC |
| 4448 | GGCAGCCTATGGTGTGAGC | GCTCACACCATAGGCTGCC |
| 4449 | GCAGCCTATGGTGTGAGCC | GGCTCACACCATAGGCTGC |
| 4450 | CAGCCTATGGTGTGAGCCC | GGGCTCACACCATAGGCTG |
| 4451 | AGCCTATGGTGTGAGCCCG | CGGGCTCACACCATAGGCT |
| 4452 | GCCTATGGTGTGAGCCCGC | GCGGGCTCACACCATAGGC |
| 4453 | CCTATGGTGTGAGCCCGCA | TGCGGGCTCACACCATAGG |
| 4454 | CTATGGTGTGAGCCCGCAC | GTGCGGGCTCACACCATAG |
| 4455 | TATGGTGTGAGCCCGCACC | GGTGCGGGCTCACACCATA |
| 4456 | ATGGTGTGAGCCCGCACCG | CGGTGCGGGCTCACACCAT |
| 4457 | TGGTGTGAGCCCGCACCGG | CCGGTGCGGGCTCACACCA |
| 4458 | GGTGTGAGCCCGCACCGGG | CCCGGTGCGGGCTCACACC |
| 4459 | GTGTGAGCCCGCACCGGGG | CCCCGGTGCGGGCTCACAC |
| 4460 | TGTGAGCCCGCACCGGGGA | TCCCCGGTGCGGGCTCACA |
| 4461 | GTGAGCCCGCACCGGGGAC | GTCCCCGGTGCGGGCTCAC |
| 4462 | TGAGCCCGCACCGGGGACA | TGTCCCCGGTGCGGGCTCA |
| 4463 | GAGCCCGCACCGGGGACAC | GTGTCCCCGGTGCGGGCTC |
| 4464 | AGCCCGCACCGGGGACACC | GGTGTCCCCGGTGCGGGCT |
| 4465 | GCCCGCACCGGGGACACCT | AGGTGTCCCCGGTGCGGGC |
| 4466 | CCCGCACCGGGGACACCTG | CAGGTGTCCCCGGTGCGGG |
| 4467 | CCGCACCGGGGACACCTGG | CCAGGTGTCCCCGGTGCGG |
| 4468 | CGCACCGGGGACACCTGGG | CCCAGGTGTCCCCGGTGCG |
| 4469 | GCACCGGGGACACCTGGGG | CCCCAGGTGTCCCCGGTGC |
| 4470 | CACCGGGGACACCTGGGGA | TCCCCAGGTGTCCCCGGTG |
| 4471 | ACCGGGGACACCTGGGGAC | GTCCCCAGGTGTCCCCGGT |
| 4472 | CCGGGGACACCTGGGGACC | GGTCCCCAGGTGTCCCCGG |
| 4473 | CGGGGACACCTGGGGACCA | TGGTCCCCAGGTGTCCCCG |
| 4474 | GGGGACACCTGGGGACCAA | TTGGTCCCCAGGTGTCCCC |
| 4475 | GGGACACCTGGGGACCAAG | CTTGGTCCCCAGGTGTCCC |
| 4476 | GGACACCTGGGGACCAAGA | TCTTGGTCCCCAGGTGTCC |
| 4477 | GACACCTGGGGACCAAGAA | TTCTTGGTCCCCAGGTGTC |
| 4478 | ACACCTGGGGACCAAGAAC | GTTCTTGGTCCCCAGGTGT |
| 4479 | CACCTGGGGACCAAGAACC | GGTTCTTGGTCCCCAGGTG |
| 4480 | ACCTGGGGACCAAGAACCT | AGGTTCTTGGTCCCCAGGT |
| 4481 | CCTGGGGACCAAGAACCTC | GAGGTTCTTGGTCCCCAGG |
| 4482 | CTGGGGACCAAGAACCTCT | AGAGGTTCTTGGTCCCCAG |
| 4483 | TGGGGACCAAGAACCTCTG | CAGAGGTTCTTGGTCCCCA |
| 4484 | GGGGACCAAGAACCTCTGT | ACAGAGGTTCTTGGTCCCC |
| 4485 | GGGACCAAGAACCTCTGTG | CACAGAGGTTCTTGGTCCC |
| 4486 | GGACCAAGAACCTCTGTGT | ACACAGAGGTTCTTGGTCC |
| 4487 | GACCAAGAACCTCTGTGTG | CACACAGAGGTTCTTGGTC |
| 4488 | ACCAAGAACCTCTGTGTGG | CCACACAGAGGTTCTTGGT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4489 | CCAAGAACCTCTGTGTGGA | TCCACACAGAGGTTCTTGG |
| 4490 | CAAGAACCTCTGTGTGGAG | CTCCACACAGAGGTTCTTG |
| 4491 | AAGAACCTCTGTGTGGAGG | CCTCCACACAGAGGTTCTT |
| 4492 | AGAACCTCTGTGTGGAGGT | ACCTCCACACAGAGGTTCT |
| 4493 | GAACCTCTGTGTGGAGGTG | CACCTCCACACAGAGGTTC |
| 4494 | AACCTCTGTGTGGAGGTGG | CCACCTCCACACAGAGGTT |
| 4495 | ACCTCTGTGTGGAGGTGGC | GCCACCTCCACACAGAGGT |
| 4496 | CCTCTGTGTGGAGGTGGCC | GGCCACCTCCACACAGAGG |
| 4497 | CTCTGTGTGGAGGTGGCCG | CGGCCACCTCCACACAGAG |
| 4498 | TCTGTGTGGAGGTGGCCGA | TCGGCCACCTCCACACAGA |
| 4499 | CTGTGTGGAGGTGGCCGAC | GTCGGCCACCTCCACACAG |
| 4500 | TGTGTGGAGGTGGCCGACC | GGTCGGCCACCTCCACACA |
| 4501 | GTGTGGAGGTGGCCGACCT | AGGTCGGCCACCTCCACAC |
| 4502 | TGTGGAGGTGGCCGACCTG | CAGGTCGGCCACCTCCACA |
| 4503 | GTGGAGGTGGCCGACCTGG | CCAGGTCGGCCACCTCCAC |
| 4504 | TGGAGGTGGCCGACCTGGT | ACCAGGTCGGCCACCTCCA |
| 4505 | GGAGGTGGCCGACCTGGTC | GACCAGGTCGGCCACCTCC |
| 4506 | GAGGTGGCCGACCTGGTCA | TGACCAGGTCGGCCACCTC |
| 4507 | AGGTGGCCGACCTGGTCAG | CTGACCAGGTCGGCCACCT |
| 4508 | GGTGGCCGACCTGGTCAGC | GCTGACCAGGTCGGCCACC |
| 4509 | GTGGCCGACCTGGTCAGCA | TGCTGACCAGGTCGGCCAC |
| 4510 | TGGCCGACCTGGTCAGCAT | ATGCTGACCAGGTCGGCCA |
| 4511 | GGCCGACCTGGTCAGCATC | GATGCTGACCAGGTCGGCC |
| 4512 | GCCGACCTGGTCAGCATCC | GGATGCTGACCAGGTCGGC |
| 4513 | CCGACCTGGTCAGCATCCT | AGGATGCTGACCAGGTCGG |
| 4514 | CGACCTGGTCAGCATCCTG | CAGGATGCTGACCAGGTCG |
| 4515 | GACCTGGTCAGCATCCTGG | CCAGGATGCTGACCAGGTC |
| 4516 | ACCTGGTCAGCATCCTGGT | ACCAGGATGCTGACCAGGT |
| 4517 | CCTGGTCAGCATCCTGGTG | CACCAGGATGCTGACCAGG |
| 4518 | CTGGTCAGCATCCTGGTGC | GCACCAGGATGCTGACCAG |
| 4519 | TGGTCAGCATCCTGGTGCA | TGCACCAGGATGCTGACCA |
| 4520 | GGTCAGCATCCTGGTGCAT | ATGCACCAGGATGCTGACC |
| 4521 | GTCAGCATCCTGGTGCATG | CATGCACCAGGATGCTGAC |
| 4522 | TCAGCATCCTGGTGCATGC | GCATGCACCAGGATGCTGA |
| 4523 | CAGCATCCTGGTGCATGCC | GGCATGCACCAGGATGCTG |
| 4524 | AGCATCCTGGTGCATGCCG | CGGCATGCACCAGGATGCT |
| 4525 | GCATCCTGGTGCATGCCGA | TCGGCATGCACCAGGATGC |
| 4526 | CATCCTGGTGCATGCCGAC | GTCGGCATGCACCAGGATG |
| 4527 | ATCCTGGTGCATGCCGACA | TGTCGGCATGCACCAGGAT |
| 4528 | TCCTGGTGCATGCCGACAC | GTGTCGGCATGCACCAGGA |
| 4529 | CCTGGTGCATGCCGACACA | TGTGTCGGCATGCACCAGG |
| 4530 | CTGGTGCATGCCGACACAC | GTGTGTCGGCATGCACCAG |
| 4531 | TGGTGCATGCCGACACACC | GGTGTGTCGGCATGCACCA |
| 4532 | GGTGCATGCCGACACACCA | TGGTGTGTCGGCATGCACC |
| 4533 | GTGCATGCCGACACACCAC | GTGGTGTGTCGGCATGCAC |
| 4534 | TGCATGCCGACACACCACT | AGTGGTGTGTCGGCATGCA |
| 4535 | GCATGCCGACACACCACTG | CAGTGGTGTGTCGGCATGC |
| 4536 | CATGCCGACACACCACTGC | GCAGTGGTGTGTCGGCATG |
| 4537 | ATGCCGACACACCACTGCC | GGCAGTGGTGTGTCGGCAT |
| 4538 | TGCCGACACACCACTGCCT | AGGCAGTGGTGTGTCGGCA |
| 4539 | GCCGACACACCACTGCCTG | CAGGCAGTGGTGTGTCGGC |
| 4540 | CCGACACACCACTGCCTGC | GCAGGCAGTGGTGTGTCGG |
| 4541 | CGACACACCACTGCCTGCC | GGCAGGCAGTGGTGTGTCG |
| 4542 | GACACACCACTGCCTGCCT | AGGCAGGCAGTGGTGTGTC |
| 4543 | ACACACCACTGCCTGCCTG | CAGGCAGGCAGTGGTGTGT |
| 4544 | CACACCACTGCCTGCCTGG | CCAGGCAGGCAGTGGTGTG |
| 4545 | ACACCACTGCCTGCCTGGC | GCCAGGCAGGCAGTGGTGT |
| 4546 | CACCACTGCCTGCCTGGCA | TGCCAGGCAGGCAGTGGTG |
| 4547 | ACCACTGCCTGCCTGGCAC | GTGCCAGGCAGGCAGTGGT |
| 4548 | CCACTGCCTGCCTGGCACC | GGTGCCAGGCAGGCAGTGG |
| 4549 | CACTGCCTGCCTGGCACCG | CGGTGCCAGGCAGGCAGTG |
| 4550 | ACTGCCTGCCTGGCACCGG | CCGGTGCCAGGCAGGCAGT |
| 4551 | CTGCCTGCCTGGCACCGGG | CCCGGTGCCAGGCAGGCAG |
| 4552 | TGCCTGCCTGGCACCGGGC | GCCCGGTGCCAGGCAGGCA |
| 4553 | GCCTGCCTGGCACCGGGCA | TGCCCGGTGCCAGGCAGGC |
| 4554 | CCTGCCTGGCACCGGGCAC | GTGCCCGGTGCCAGGCAGG |
| 4555 | CTGCCTGGCACCGGGCACA | TGTGCCCGGTGCCAGGCAG |
| 4556 | TGCCTGGCACCGGGCACAG | CTGTGCCCGGTGCCAGGCA |
| 4557 | GCCTGGCACCGGGCACAGA | TCTGTGCCCGGTGCCAGGC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4558 | CCTGGCACCGGGCACAGAA | TTCTGTGCCCGGTGCCAGG |
| 4559 | CTGGCACCGGGCACAGAAA | TTTCTGTGCCCGGTGCCAG |
| 4560 | TGGCACCGGGCACAGAAAG | CTTTCTGTGCCCGGTGCCA |
| 4561 | GGCACCGGGCACAGAAAGA | TCTTTCTGTGCCCGGTGCC |
| 4562 | GCACCGGGCACAGAAAGAC | GTCTTTCTGTGCCCGGTGC |
| 4563 | CACCGGGCACAGAAAGACT | AGTCTTTCTGTGCCCGGTG |
| 4564 | ACCGGGCACAGAAAGACTT | AAGTCTTTCTGTGCCCGGT |
| 4565 | CCGGGCACAGAAAGACTTC | GAAGTCTTTCTGTGCCCGG |
| 4566 | CGGGCACAGAAAGACTTCC | GGAAGTCTTTCTGTGCCCG |
| 4567 | GGGCACAGAAAGACTTCCT | AGGAAGTCTTTCTGTGCCC |
| 4568 | GGCACAGAAAGACTTCCTT | AAGGAAGTCTTTCTGTGCC |
| 4569 | GCACAGAAAGACTTCCTTT | AAAGGAAGTCTTTCTGTGC |
| 4570 | CACAGAAAGACTTCCTTTC | GAAAGGAAGTCTTTCTGTG |
| 4571 | ACAGAAAGACTTCCTTTCA | TGAAAGGAAGTCTTTCTGT |
| 4572 | CAGAAAGACTTCCTTTCAG | CTGAAAGGAAGTCTTTCTG |
| 4573 | AGAAAGACTTCCTTTCAGG | CCTGAAAGGAAGTCTTTCT |
| 4574 | GAAAGACTTCCTTTCAGGC | GCCTGAAAGGAAGTCTTTC |
| 4575 | AAAGACTTCCTTTCAGGCC | GGCCTGAAAGGAAGTCTTT |
| 4576 | AAGACTTCCTTTCAGGCCT | AGGCCTGAAAGGAAGTCTT |
| 4577 | AGACTTCCTTTCAGGCCTG | CAGGCCTGAAAGGAAGTCT |
| 4578 | GACTTCCTTTCAGGCCTGG | CCAGGCCTGAAAGGAAGTC |
| 4579 | ACTTCCTTTCAGGCCTGGA | TCCAGGCCTGAAAGGAAGT |
| 4580 | CTTCCTTTCAGGCCTGGAC | GTCCAGGCCTGAAAGGAAG |
| 4581 | TTCCTTTCAGGCCTGGACG | CGTCCAGGCCTGAAAGGAA |
| 4582 | TCCTTTCAGGCCTGGACGG | CCGTCCAGGCCTGAAAGGA |
| 4583 | CCTTTCAGGCCTGGACGGG | CCCGTCCAGGCCTGAAAGG |
| 4584 | CTTTCAGGCCTGGACGGGG | CCCCGTCCAGGCCTGAAAG |
| 4585 | TTTCAGGCCTGGACGGGGA | TCCCCGTCCAGGCCTGAAA |
| 4586 | TTCAGGCCTGGACGGGGAG | CTCCCCGTCCAGGCCTGAA |
| 4587 | TCAGGCCTGGACGGGGAGG | CCTCCCCGTCCAGGCCTGA |
| 4588 | CAGGCCTGGACGGGGAGGG | CCCTCCCCGTCCAGGCCTG |
| 4589 | AGGCCTGGACGGGGAGGGG | CCCCTCCCCGTCCAGGCCT |
| 4590 | GGCCTGGACGGGGAGGGGC | GCCCCTCCCCGTCCAGGCC |
| 4591 | GCCTGGACGGGGAGGGGCT | AGCCCCTCCCCGTCCAGGC |
| 4592 | CCTGGACGGGGAGGGGCTC | GAGCCCCTCCCCGTCCAGG |
| 4593 | CTGGACGGGGAGGGGCTCT | AGAGCCCCTCCCCGTCCAG |
| 4594 | TGGACGGGGAGGGGCTCTG | CAGAGCCCCTCCCCGTCCA |
| 4595 | GGACGGGGAGGGGCTCTGG | CCAGAGCCCCTCCCCGTCC |
| 4596 | GACGGGGAGGGGCTCTGGT | ACCAGAGCCCCTCCCCGTC |
| 4597 | ACGGGGAGGGGCTCTGGTC | GACCAGAGCCCCTCCCCGT |
| 4598 | CGGGGAGGGGCTCTGGTCT | AGACCAGAGCCCCTCCCCG |
| 4599 | GGGGAGGGGCTCTGGTCTC | GAGACCAGAGCCCCTCCCC |
| 4600 | GGGAGGGGCTCTGGTCTCC | GGAGACCAGAGCCCCTCCC |
| 4601 | GGAGGGGCTCTGGTCTCCG | CGGAGACCAGAGCCCCTCC |
| 4602 | GAGGGGCTCTGGTCTCCGG | CCGGAGACCAGAGCCCCTC |
| 4603 | AGGGGCTCTGGTCTCCGGG | CCCGGAGACCAGAGCCCCT |
| 4604 | GGGGCTCTGGTCTCCGGGC | GCCCGGAGACCAGAGCCCC |
| 4605 | GGGCTCTGGTCTCCGGGCA | TGCCCGGAGACCAGAGCCC |
| 4606 | GGCTCTGGTCTCCGGGCAG | CTGCCCGGAGACCAGAGCC |
| 4607 | GCTCTGGTCTCCGGGCAGC | GCTGCCCGGAGACCAGAGC |
| 4608 | CTCTGGTCTCCGGGCAGCC | GGCTGCCCGGAGACCAGAG |
| 4609 | TCTGGTCTCCGGGCAGCCA | TGGCTGCCCGGAGACCAGA |
| 4610 | CTGGTCTCCGGGCAGCCAG | CTGGCTGCCCGGAGACCAG |
| 4611 | TGGTCTCCGGGCAGCCAGG | CCTGGCTGCCCGGAGACCA |
| 4612 | GGTCTCCGGGCAGCCAGGT | ACCTGGCTGCCCGGAGACC |
| 4613 | GTCTCCGGGCAGCCAGGTC | GACCTGGCTGCCCGGAGAC |
| 4614 | TCTCCGGGCAGCCAGGTCA | TGACCTGGCTGCCCGGAGA |
| 4615 | CTCCGGGCAGCCAGGTCAG | CTGACCTGGCTGCCCGGAG |
| 4616 | TCCGGGCAGCCAGGTCAGC | GCTGACCTGGCTGCCCGGA |
| 4617 | CCGGGCAGCCAGGTCAGCA | TGCTGACCTGGCTGCCCGG |
| 4618 | CGGGCAGCCAGGTCAGCAC | GTGCTGACCTGGCTGCCCG |
| 4619 | GGGCAGCCAGGTCAGCACT | AGTGCTGACCTGGCTGCCC |
| 4620 | GGCAGCCAGGTCAGCACTG | CAGTGCTGACCTGGCTGCC |
| 4621 | GCAGCCAGGTCAGCACTGT | ACAGTGCTGACCTGGCTGC |
| 4622 | CAGCCAGGTCAGCACTGTG | CACAGTGCTGACCTGGCTG |
| 4623 | AGCCAGGTCAGCACTGTGT | ACACAGTGCTGACCTGGCT |
| 4624 | GCCAGGTCAGCACTGTGTG | CACACAGTGCTGACCTGGC |
| 4625 | CCAGGTCAGCACTGTGTGG | CCACACAGTGCTGACCTGG |
| 4626 | CAGGTCAGCACTGTGTGGC | GCCACACAGTGCTGACCTG |

TABLE 1-continued cDNA Human Hairless 19-mer Target Sequences and Complement Referenced to NM_005144-
*Homo sapiens* hairless homolog (mouse) (HR), transcript variant 1, complete mRNA (1-5699 bp).
(SEQ ID NO: for Sense equals (2X - 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 4627 | AGGTCAGCACTGTGTGGCA | TGCCACACAGTGCTGACCT |
| 4628 | GGTCAGCACTGTGTGGCAC | GTGCCACACAGTGCTGACC |
| 4629 | GTCAGCACTGTGTGGCACG | CGTGCCACACAGTGCTGAC |
| 4630 | TCAGCACTGTGTGGCACGT | ACGTGCCACACAGTGCTGA |
| 4631 | CAGCACTGTGTGGCACGTG | CACGTGCCACACAGTGCTG |
| 4632 | AGCACTGTGTGGCACGTGT | ACACGTGCCACACAGTGCT |
| 4633 | GCACTGTGTGGCACGTGTT | AACACGTGCCACACAGTGC |
| 4634 | CACTGTGTGGCACGTGTTC | GAACACGTGCCACACAGTG |
| 4635 | ACTGTGTGGCACGTGTTCC | GGAACACGTGCCACACAGT |
| 4636 | CTGTGTGGCACGTGTTCCG | CGGAACACGTGCCACACAG |
| 4637 | TGTGTGGCACGTGTTCCGG | CCGGAACACGTGCCACACA |
| 4638 | GTGTGGCACGTGTTCCGGG | CCCGGAACACGTGCCACAC |
| 4639 | TGTGGCACGTGTTCCGGGC | GCCCGGAACACGTGCCACA |
| 4640 | GTGGCACGTGTTCCGGGCA | TGCCCGGAACACGTGCCAC |
| 4641 | TGGCACGTGTTCCGGGCAC | GTGCCCGGAACACGTGCCA |
| 4642 | GGCACGTGTTCCGGGCACA | TGTGCCCGGAACACGTGCC |
| 4643 | GCACGTGTTCCGGGCACAG | CTGTGCCCGGAACACGTGC |
| 4644 | CACGTGTTCCGGGCACAGG | CCTGTGCCCGGAACACGTG |
| 4645 | ACGTGTTCCGGGCACAGGA | TCCTGTGCCCGGAACACGT |
| 4646 | CGTGTTCCGGGCACAGGAC | GTCCTGTGCCCGGAACACG |
| 4647 | GTGTTCCGGGCACAGGACG | CGTCCTGTGCCCGGAACAC |
| 4648 | TGTTCCGGGCACAGGACGC | GCGTCCTGTGCCCGGAACA |
| 4649 | GTTCCGGGCACAGGACGCC | GGCGTCCTGTGCCCGGAAC |
| 4650 | TTCCGGGCACAGGACGCCC | GGGCGTCCTGTGCCCGGAA |
| 4651 | TCCGGGCACAGGACGCCCA | TGGGCGTCCTGTGCCCGGA |
| 4652 | CCGGGCACAGGACGCCCAG | CTGGGCGTCCTGTGCCCGG |
| 4653 | CGGGCACAGGACGCCCAGC | GCTGGGCGTCCTGTGCCCG |
| 4654 | GGGCACAGGACGCCCAGCG | CGCTGGGCGTCCTGTGCCC |
| 4655 | GGCACAGGACGCCCAGCGC | GCGCTGGGCGTCCTGTGCC |
| 4656 | GCACAGGACGCCCAGCGCA | TGCGCTGGGCGTCCTGTGC |
| 4657 | CACAGGACGCCCAGCGCAT | ATGCGCTGGGCGTCCTGTG |
| 4658 | ACAGGACGCCCAGCGCATC | GATGCGCTGGGCGTCCTGT |
| 4659 | CAGGACGCCCAGCGCATCC | GGATGCGCTGGGCGTCCTG |
| 4660 | AGGACGCCCAGCGCATCCG | CGGATGCGCTGGGCGTCCT |
| 4661 | GGACGCCCAGCGCATCCGC | GCGGATGCGCTGGGCGTCC |
| 4662 | GACGCCCAGCGCATCCGCC | GGCGGATGCGCTGGGCGTC |
| 4663 | ACGCCCAGCGCATCCGCCG | CGGCGGATGCGCTGGGCGT |
| 4664 | CGCCCAGCGCATCCGCCGC | GCGGCGGATGCGCTGGGCG |
| 4665 | GCCCAGCGCATCCGCCGCT | AGCGGCGGATGCGCTGGGC |
| 4666 | CCCAGCGCATCCGCCGCTT | AAGCGGCGGATGCGCTGGG |
| 4667 | CCAGCGCATCCGCCGCTTT | AAAGCGGCGGATGCGCTGG |
| 4668 | CAGCGCATCCGCCGCTTTC | GAAAGCGGCGGATGCGCTG |
| 4669 | AGCGCATCCGCCGCTTTCT | AGAAAGCGGCGGATGCGCT |
| 4670 | GCGCATCCGCCGCTTTCTC | GAGAAAGCGGCGGATGCGC |
| 4671 | CGCATCCGCCGCTTTCTCC | GGAGAAAGCGGCGGATGCG |
| 4672 | GCATCCGCCGCTTTCTCCA | TGGAGAAAGCGGCGGATGC |
| 4673 | CATCCGCCGCTTTCTCCAG | CTGGAGAAAGCGGCGGATG |
| 4674 | ATCCGCCGCTTTCTCCAGA | TCTGGAGAAAGCGGCGGAT |
| 4675 | TCCGCCGCTTTCTCCAGAT | ATCTGGAGAAAGCGGCGGA |
| 4676 | CCGCCGCTTTCTCCAGATG | CATCTGGAGAAAGCGGCGG |
| 4677 | CGCCGCTTTCTCCAGATGG | CCATCTGGAGAAAGCGGCG |
| 4678 | GCCGCTTTCTCCAGATGGT | ACCATCTGGAGAAAGCGGC |
| 4679 | CCGCTTTCTCCAGATGGTG | CACCATCTGGAGAAAGCGG |
| 4680 | CGCTTTCTCCAGATGGTGT | ACACCATCTGGAGAAAGCG |
| 4681 | GCTTTCTCCAGATGGTGTG | CACACCATCTGGAGAAAGC |
| 4682 | CTTTCTCCAGATGGTGTGC | GCACACCATCTGGAGAAAG |
| 4683 | TTTCTCCAGATGGTGTGCC | GGCACACCATCTGGAGAAA |
| 4684 | TTCTCCAGATGGTGTGCCC | GGGCACACCATCTGGAGAA |
| 4685 | TCTCCAGATGGTGTGCCCG | CGGGCACACCATCTGGAGA |
| 4686 | CTCCAGATGGTGTGCCCGG | CCGGGCACACCATCTGGAG |
| 4687 | TCCAGATGGTGTGCCCGGC | GCCGGGCACACCATCTGGA |
| 4688 | CCAGATGGTGTGCCCGGCC | GGCCGGGCACACCATCTGG |
| 4689 | CAGATGGTGTGCCCGGCCG | CGGCCGGGCACACCATCTG |
| 4690 | AGATGGTGTGCCCGGCCGG | CCGGCCGGGCACACCATCT |
| 4691 | GATGGTGTGCCCGGCCGGG | CCCGGCCGGGCACACCATC |
| 4692 | ATGGTGTGCCCGGCCGGGG | CCCCGGCCGGGCACACCAT |
| 4693 | TGGTGTGCCCGGCCGGGGC | GCCCCGGCCGGGCACACCA |
| 4694 | GGTGTGCCCGGCCGGGGCA | TGCCCCGGCCGGGCACACC |
| 4695 | GTGTGCCCGGCCGGGGCAG | CTGCCCCGGCCGGGCACAC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4696 | TGTGCCCGGCCGGGGCAGG | CCTGCCCCGGCCGGGCACA |
| 4697 | GTGCCCGGCCGGGGCAGGC | GCCTGCCCCGGCCGGGCAC |
| 4698 | TGCCCGGCCGGGGCAGGCG | CGCCTGCCCCGGCCGGGCA |
| 4699 | GCCCGGCCGGGGCAGGCGC | GCGCCTGCCCCGGCCGGGC |
| 4700 | CCCGGCCGGGGCAGGCGCC | GGCGCCTGCCCCGGCCGGG |
| 4701 | CCGGCCGGGGCAGGCGCCC | GGGCGCCTGCCCCGGCCGG |
| 4702 | CGGCCGGGGCAGGCGCCCT | AGGGCGCCTGCCCCGGCCG |
| 4703 | GGCCGGGGCAGGCGCCCTG | CAGGGCGCCTGCCCCGGCC |
| 4704 | GCCGGGGCAGGCGCCCTGG | CCAGGGCGCCTGCCCCGGC |
| 4705 | CCGGGGCAGGCGCCCTGGA | TCCAGGGCGCCTGCCCCGG |
| 4706 | CGGGGCAGGCGCCCTGGAG | CTCCAGGGCGCCTGCCCCG |
| 4707 | GGGGCAGGCGCCCTGGAGC | GCTCCAGGGCGCCTGCCCC |
| 4708 | GGGCAGGCGCCCTGGAGCC | GGCTCCAGGGCGCCTGCCC |
| 4709 | GGCAGGCGCCCTGGAGCCT | AGGCTCCAGGGCGCCTGCC |
| 4710 | GCAGGCGCCCTGGAGCCTG | CAGGCTCCAGGGCGCCTGC |
| 4711 | CAGGCGCCCTGGAGCCTGG | CCAGGCTCCAGGGCGCCTG |
| 4712 | AGGCGCCCTGGAGCCTGGC | GCCAGGCTCCAGGGCGCCT |
| 4713 | GGCGCCCTGGAGCCTGGCG | CGCCAGGCTCCAGGGCGCC |
| 4714 | GCGCCCTGGAGCCTGGCGC | GCGCCAGGCTCCAGGGCGC |
| 4715 | CGCCCTGGAGCCTGGCGCC | GGCGCCAGGCTCCAGGGCG |
| 4716 | GCCCTGGAGCCTGGCGCCC | GGGCGCCAGGCTCCAGGGC |
| 4717 | CCCTGGAGCCTGGCGCCCC | GGGGCGCCAGGCTCCAGGG |
| 4718 | CCTGGAGCCTGGCGCCCCA | TGGGGCGCCAGGCTCCAGG |
| 4719 | CTGGAGCCTGGCGCCCCAG | CTGGGGCGCCAGGCTCCAG |
| 4720 | TGGAGCCTGGCGCCCCAGG | CCTGGGGCGCCAGGCTCCA |
| 4721 | GGAGCCTGGCGCCCCAGGC | GCCTGGGGCGCCAGGCTCC |
| 4722 | GAGCCTGGCGCCCCAGGCA | TGCCTGGGGCGCCAGGCTC |
| 4723 | AGCCTGGCGCCCCAGGCAG | CTGCCTGGGGCGCCAGGCT |
| 4724 | GCCTGGCGCCCCAGGCAGC | GCTGCCTGGGGCGCCAGGC |
| 4725 | CCTGGCGCCCCAGGCAGCT | AGCTGCCTGGGGCGCCAGG |
| 4726 | CTGGCGCCCCAGGCAGCTG | CAGCTGCCTGGGGCGCCAG |
| 4727 | TGGCGCCCCAGGCAGCTGC | GCAGCTGCCTGGGGCGCCA |
| 4728 | GGCGCCCCAGGCAGCTGCT | AGCAGCTGCCTGGGGCGCC |
| 4729 | GCGCCCCAGGCAGCTGCTA | TAGCAGCTGCCTGGGGCGC |
| 4730 | CGCCCCAGGCAGCTGCTAC | GTAGCAGCTGCCTGGGGCG |
| 4731 | GCCCCAGGCAGCTGCTACC | GGTAGCAGCTGCCTGGGGC |
| 4732 | CCCCAGGCAGCTGCTACCT | AGGTAGCAGCTGCCTGGGG |
| 4733 | CCCAGGCAGCTGCTACCTG | CAGGTAGCAGCTGCCTGGG |
| 4734 | CCAGGCAGCTGCTACCTGG | CCAGGTAGCAGCTGCCTGG |
| 4735 | CAGGCAGCTGCTACCTGGA | TCCAGGTAGCAGCTGCCTG |
| 4736 | AGGCAGCTGCTACCTGGAT | ATCCAGGTAGCAGCTGCCT |
| 4737 | GGCAGCTGCTACCTGGATG | CATCCAGGTAGCAGCTGCC |
| 4738 | GCAGCTGCTACCTGGATGC | GCATCCAGGTAGCAGCTGC |
| 4739 | CAGCTGCTACCTGGATGCA | TGCATCCAGGTAGCAGCTG |
| 4740 | AGCTGCTACCTGGATGCAG | CTGCATCCAGGTAGCAGCT |
| 4741 | GCTGCTACCTGGATGCAGG | CCTGCATCCAGGTAGCAGC |
| 4742 | CTGCTACCTGGATGCAGGG | CCCTGCATCCAGGTAGCAG |
| 4743 | TGCTACCTGGATGCAGGGC | GCCCTGCATCCAGGTAGCA |
| 4744 | GCTACCTGGATGCAGGGCT | AGCCCTGCATCCAGGTAGC |
| 4745 | CTACCTGGATGCAGGGCTG | CAGCCCTGCATCCAGGTAG |
| 4746 | TACCTGGATGCAGGGCTGC | GCAGCCCTGCATCCAGGTA |
| 4747 | ACCTGGATGCAGGGCTGCG | CGCAGCCCTGCATCCAGGT |
| 4748 | CCTGGATGCAGGGCTGCGG | CCGCAGCCCTGCATCCAGG |
| 4749 | CTGGATGCAGGGCTGCGGC | GCCGCAGCCCTGCATCCAG |
| 4750 | TGGATGCAGGGCTGCGGCG | CGCCGCAGCCCTGCATCCA |
| 4751 | GGATGCAGGGCTGCGGCGG | CCGCCGCAGCCCTGCATCC |
| 4752 | GATGCAGGGCTGCGGCGGC | GCCGCCGCAGCCCTGCATC |
| 4753 | ATGCAGGGCTGCGGCGGCG | CGCCGCCGCAGCCCTGCAT |
| 4754 | TGCAGGGCTGCGGCGGCGC | GCGCCGCCGCAGCCCTGCA |
| 4755 | GCAGGGCTGCGGCGGCGCC | GGCGCCGCCGCAGCCCTGC |
| 4756 | CAGGGCTGCGGCGGCGCCT | AGGCGCCGCCGCAGCCCTG |
| 4757 | AGGGCTGCGGCGGCGCCTG | CAGGCGCCGCCGCAGCCCT |
| 4758 | GGGCTGCGGCGGCGCCTGC | GCAGGCGCCGCCGCAGCCC |
| 4759 | GGCTGCGGCGGCGCCTGCG | CGCAGGCGCCGCCGCAGCC |
| 4760 | GCTGCGGCGGCGCCTGCGG | CCGCAGGCGCCGCCGCAGC |
| 4761 | CTGCGGCGGCGCCTGCGGG | CCCGCAGGCGCCGCCGCAG |
| 4762 | TGCGGCGGCGCCTGCGGGA | TCCCGCAGGCGCCGCCGCA |
| 4763 | GCGGCGGCGCCTGCGGGAG | CTCCCGCAGGCGCCGCCGC |
| 4764 | CGGCGGCGCCTGCGGGAGG | CCTCCCGCAGGCGCCGCCG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 4765 | GGCGGCGCCTGCGGGAGGA | TCCTCCCGCAGGCGCCGCC |
| 4766 | GCGGCGCCTGCGGGAGGAG | CTCCTCCCGCAGGCGCCGC |
| 4767 | CGGCGCCTGCGGGAGGAGT | ACTCCTCCCGCAGGCGCCG |
| 4768 | GGCGCCTGCGGGAGGAGTG | CACTCCTCCCGCAGGCGCC |
| 4769 | GCGCCTGCGGGAGGAGTGG | CCACTCCTCCCGCAGGCGC |
| 4770 | CGCCTGCGGGAGGAGTGGG | CCCACTCCTCCCGCAGGCG |
| 4771 | GCCTGCGGGAGGAGTGGGG | CCCCACTCCTCCCGCAGGC |
| 4772 | CCTGCGGGAGGAGTGGGGC | GCCCCACTCCTCCCGCAGG |
| 4773 | CTGCGGGAGGAGTGGGGCG | CGCCCCACTCCTCCCGCAG |
| 4774 | TGCGGGAGGAGTGGGGCGT | ACGCCCCACTCCTCCCGCA |
| 4775 | GCGGGAGGAGTGGGGCGTG | CACGCCCCACTCCTCCCGC |
| 4776 | CGGGAGGAGTGGGGCGTGA | TCACGCCCCACTCCTCCCG |
| 4777 | GGGAGGAGTGGGGCGTGAG | CTCACGCCCCACTCCTCCC |
| 4778 | GGAGGAGTGGGGCGTGAGC | GCTCACGCCCCACTCCTCC |
| 4779 | GAGGAGTGGGGCGTGAGCT | AGCTCACGCCCCACTCCTC |
| 4780 | AGGAGTGGGGCGTGAGCTG | CAGCTCACGCCCCACTCCT |
| 4781 | GGAGTGGGGCGTGAGCTGC | GCAGCTCACGCCCCACTCC |
| 4782 | GAGTGGGGCGTGAGCTGCT | AGCAGCTCACGCCCCACTC |
| 4783 | AGTGGGGCGTGAGCTGCTG | CAGCAGCTCACGCCCCACT |
| 4784 | GTGGGGCGTGAGCTGCTGG | CCAGCAGCTCACGCCCCAC |
| 4785 | TGGGGCGTGAGCTGCTGGA | TCCAGCAGCTCACGCCCCA |
| 4786 | GGGGCGTGAGCTGCTGGAC | GTCCAGCAGCTCACGCCCC |
| 4787 | GGGCGTGAGCTGCTGGACC | GGTCCAGCAGCTCACGCCC |
| 4788 | GGCGTGAGCTGCTGGACCC | GGGTCCAGCAGCTCACGCC |
| 4789 | GCGTGAGCTGCTGGACCCT | AGGGTCCAGCAGCTCACGC |
| 4790 | CGTGAGCTGCTGGACCCTG | CAGGGTCCAGCAGCTCACG |
| 4791 | GTGAGCTGCTGGACCCTGC | GCAGGGTCCAGCAGCTCAC |
| 4792 | TGAGCTGCTGGACCCTGCT | AGCAGGGTCCAGCAGCTCA |
| 4793 | GAGCTGCTGGACCCTGCTC | GAGCAGGGTCCAGCAGCTC |
| 4794 | AGCTGCTGGACCCTGCTCC | GGAGCAGGGTCCAGCAGCT |
| 4795 | GCTGCTGGACCCTGCTCCA | TGGAGCAGGGTCCAGCAGC |
| 4796 | CTGCTGGACCCTGCTCCAG | CTGGAGCAGGGTCCAGCAG |
| 4797 | TGCTGGACCCTGCTCCAGG | CCTGGAGCAGGGTCCAGCA |
| 4798 | GCTGGACCCTGCTCCAGGC | GCCTGGAGCAGGGTCCAGC |
| 4799 | CTGGACCCTGCTCCAGGCC | GGCCTGGAGCAGGGTCCAG |
| 4800 | TGGACCCTGCTCCAGGCCC | GGGCCTGGAGCAGGGTCCA |
| 4801 | GGACCCTGCTCCAGGCCCC | GGGGCCTGGAGCAGGGTCC |
| 4802 | GACCCTGCTCCAGGCCCCC | GGGGGCCTGGAGCAGGGTC |
| 4803 | ACCCTGCTCCAGGCCCCCG | CGGGGGCCTGGAGCAGGGT |
| 4804 | CCCTGCTCCAGGCCCCCGG | CCGGGGGCCTGGAGCAGGG |
| 4805 | CCTGCTCCAGGCCCCCGGA | TCCGGGGGCCTGGAGCAGG |
| 4806 | CTGCTCCAGGCCCCCGGAG | CTCCGGGGGCCTGGAGCAG |
| 4807 | TGCTCCAGGCCCCCGGAGA | TCTCCGGGGGCCTGGAGCA |
| 4808 | GCTCCAGGCCCCCGGAGAG | CTCTCCGGGGGCCTGGAGC |
| 4809 | CTCCAGGCCCCCGGAGAGG | CCTCTCCGGGGGCCTGGAG |
| 4810 | TCCAGGCCCCCGGAGAGGC | GCCTCTCCGGGGGCCTGGA |
| 4811 | CCAGGCCCCCGGAGAGGCC | GGCCTCTCCGGGGGCCTGG |
| 4812 | CAGGCCCCCGGAGAGGCCG | CGGCCTCTCCGGGGGCCTG |
| 4813 | AGGCCCCCGGAGAGGCCGT | ACGGCCTCTCCGGGGGCCT |
| 4814 | GGCCCCCGGAGAGGCCGTG | CACGGCCTCTCCGGGGGCC |
| 4815 | GCCCCCGGAGAGGCCGTGC | GCACGGCCTCTCCGGGGGC |
| 4816 | CCCCCGGAGAGGCCGTGCT | AGCACGGCCTCTCCGGGGG |
| 4817 | CCCCGGAGAGGCCGTGCTG | CAGCACGGCCTCTCCGGGG |
| 4818 | CCCGGAGAGGCCGTGCTGG | CCAGCACGGCCTCTCCGGG |
| 4819 | CCGGAGAGGCCGTGCTGGT | ACCAGCACGGCCTCTCCGG |
| 4820 | CGGAGAGGCCGTGCTGGTG | CACCAGCACGGCCTCTCCG |
| 4821 | GGAGAGGCCGTGCTGGTGC | GCACCAGCACGGCCTCTCC |
| 4822 | GAGAGGCCGTGCTGGTGCC | GGCACCAGCACGGCCTCTC |
| 4823 | AGAGGCCGTGCTGGTGCCT | AGGCACCAGCACGGCCTCT |
| 4824 | GAGGCCGTGCTGGTGCCTG | CAGGCACCAGCACGGCCTC |
| 4825 | AGGCCGTGCTGGTGCCTGC | GCAGGCACCAGCACGGCCT |
| 4826 | GGCCGTGCTGGTGCCTGCA | TGCAGGCACCAGCACGGCC |
| 4827 | GCCGTGCTGGTGCCTGCAG | CTGCAGGCACCAGCACGGC |
| 4828 | CCGTGCTGGTGCCTGCAGG | CCTGCAGGCACCAGCACGG |
| 4829 | CGTGCTGGTGCCTGCAGGG | CCCTGCAGGCACCAGCACG |
| 4830 | GTGCTGGTGCCTGCAGGGG | CCCCTGCAGGCACCAGCAC |
| 4831 | TGCTGGTGCCTGCAGGGGC | GCCCCTGCAGGCACCAGCA |
| 4832 | GCTGGTGCCTGCAGGGGCT | AGCCCCTGCAGGCACCAGC |
| 4833 | CTGGTGCCTGCAGGGGCTC | GAGCCCCTGCAGGCACCAG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4834 | TGGTGCCTGCAGGGGCTCC | GGAGCCCCTGCAGGCACCA |
| 4835 | GGTGCCTGCAGGGGCTCCC | GGGAGCCCCTGCAGGCACC |
| 4836 | GTGCCTGCAGGGGCTCCCC | GGGGAGCCCCTGCAGGCAC |
| 4837 | TGCCTGCAGGGGCTCCCCA | TGGGGAGCCCCTGCAGGCA |
| 4838 | GCCTGCAGGGGCTCCCCAC | GTGGGGAGCCCCTGCAGGC |
| 4839 | CCTGCAGGGGCTCCCCACC | GGTGGGGAGCCCCTGCAGG |
| 4840 | CTGCAGGGGCTCCCCACCA | TGGTGGGGAGCCCCTGCAG |
| 4841 | TGCAGGGGCTCCCCACCAG | CTGGTGGGGAGCCCCTGCA |
| 4842 | GCAGGGGCTCCCCACCAGG | CCTGGTGGGGAGCCCCTGC |
| 4843 | CAGGGGCTCCCCACCAGGT | ACCTGGTGGGGAGCCCCTG |
| 4844 | AGGGGCTCCCCACCAGGTG | CACCTGGTGGGGAGCCCCT |
| 4845 | GGGGCTCCCCACCAGGTGC | GCACCTGGTGGGGAGCCCC |
| 4846 | GGGCTCCCCACCAGGTGCA | TGCACCTGGTGGGGAGCCC |
| 4847 | GGCTCCCCACCAGGTGCAG | CTGCACCTGGTGGGGAGCC |
| 4848 | GCTCCCCACCAGGTGCAGG | CCTGCACCTGGTGGGGAGC |
| 4849 | CTCCCCACCAGGTGCAGGG | CCCTGCACCTGGTGGGGAG |
| 4850 | TCCCCACCAGGTGCAGGGC | GCCCTGCACCTGGTGGGGA |
| 4851 | CCCCACCAGGTGCAGGGCC | GGCCCTGCACCTGGTGGGG |
| 4852 | CCCACCAGGTGCAGGGCCT | AGGCCCTGCACCTGGTGGG |
| 4853 | CCACCAGGTGCAGGGCCTG | CAGGCCCTGCACCTGGTGG |
| 4854 | CACCAGGTGCAGGGCCTGG | CCAGGCCCTGCACCTGGTG |
| 4855 | ACCAGGTGCAGGGCCTGGT | ACCAGGCCCTGCACCTGGT |
| 4856 | CCAGGTGCAGGGCCTGGTG | CACCAGGCCCTGCACCTGG |
| 4857 | CAGGTGCAGGGCCTGGTGA | TCACCAGGCCCTGCACCTG |
| 4858 | AGGTGCAGGGCCTGGTGAG | CTCACCAGGCCCTGCACCT |
| 4859 | GGTGCAGGGCCTGGTGAGC | GCTCACCAGGCCCTGCACC |
| 4860 | GTGCAGGGCCTGGTGAGCA | TGCTCACCAGGCCCTGCAC |
| 4861 | TGCAGGGCCTGGTGAGCAC | GTGCTCACCAGGCCCTGCA |
| 4862 | GCAGGGCCTGGTGAGCACA | TGTGCTCACCAGGCCCTGC |
| 4863 | CAGGGCCTGGTGAGCACAG | CTGTGCTCACCAGGCCCTG |
| 4864 | AGGGCCTGGTGAGCACAGT | ACTGTGCTCACCAGGCCCT |
| 4865 | GGGCCTGGTGAGCACAGTC | GACTGTGCTCACCAGGCCC |
| 4866 | GGCCTGGTGAGCACAGTCA | TGACTGTGCTCACCAGGCC |
| 4867 | GCCTGGTGAGCACAGTCAG | CTGACTGTGCTCACCAGGC |
| 4868 | CCTGGTGAGCACAGTCAGC | GCTGACTGTGCTCACCAGG |
| 4869 | CTGGTGAGCACAGTCAGCG | CGCTGACTGTGCTCACCAG |
| 4870 | TGGTGAGCACAGTCAGCGT | ACGCTGACTGTGCTCACCA |
| 4871 | GGTGAGCACAGTCAGCGTC | GACGCTGACTGTGCTCACC |
| 4872 | GTGAGCACAGTCAGCGTCA | TGACGCTGACTGTGCTCAC |
| 4873 | TGAGCACAGTCAGCGTCAC | GTGACGCTGACTGTGCTCA |
| 4874 | GAGCACAGTCAGCGTCACT | AGTGACGCTGACTGTGCTC |
| 4875 | AGCACAGTCAGCGTCACTC | GAGTGACGCTGACTGTGCT |
| 4876 | GCACAGTCAGCGTCACTCA | TGAGTGACGCTGACTGTGC |
| 4877 | CACAGTCAGCGTCACTCAG | CTGAGTGACGCTGACTGTG |
| 4878 | ACAGTCAGCGTCACTCAGC | GCTGAGTGACGCTGACTGT |
| 4879 | CAGTCAGCGTCACTCAGCA | TGCTGAGTGACGCTGACTG |
| 4880 | AGTCAGCGTCACTCAGCAC | GTGCTGAGTGACGCTGACT |
| 4881 | GTCAGCGTCACTCAGCACT | AGTGCTGAGTGACGCTGAC |
| 4882 | TCAGCGTCACTCAGCACTT | AAGTGCTGAGTGACGCTGA |
| 4883 | CAGCGTCACTCAGCACTTC | GAAGTGCTGAGTGACGCTG |
| 4884 | AGCGTCACTCAGCACTTCC | GGAAGTGCTGAGTGACGCT |
| 4885 | GCGTCACTCAGCACTTCCT | AGGAAGTGCTGAGTGACGC |
| 4886 | CGTCACTCAGCACTTCCTC | GAGGAAGTGCTGAGTGACG |
| 4887 | GTCACTCAGCACTTCCTCT | AGAGGAAGTGCTGAGTGAC |
| 4888 | TCACTCAGCACTTCCTCTC | GAGAGGAAGTGCTGAGTGA |
| 4889 | CACTCAGCACTTCCTCTCC | GGAGAGGAAGTGCTGAGTG |
| 4890 | ACTCAGCACTTCCTCTCCC | GGGAGAGGAAGTGCTGAGT |
| 4891 | CTCAGCACTTCCTCTCCCC | GGGGAGAGGAAGTGCTGAG |
| 4892 | TCAGCACTTCCTCTCCCCT | AGGGGAGAGGAAGTGCTGA |
| 4893 | CAGCACTTCCTCTCCCCTG | CAGGGGAGAGGAAGTGCTG |
| 4894 | AGCACTTCCTCTCCCCTGA | TCAGGGGAGAGGAAGTGCT |
| 4895 | GCACTTCCTCTCCCCTGAG | CTCAGGGGAGAGGAAGTGC |
| 4896 | CACTTCCTCTCCCCTGAGA | TCTCAGGGGAGAGGAAGTG |
| 4897 | ACTTCCTCTCCCCTGAGAC | GTCTCAGGGGAGAGGAAGT |
| 4898 | CTTCCTCTCCCCTGAGACC | GGTCTCAGGGGAGAGGAAG |
| 4899 | TTCCTCTCCCCTGAGACCT | AGGTCTCAGGGGAGAGGAA |
| 4900 | TCCTCTCCCCTGAGACCTC | GAGGTCTCAGGGGAGAGGA |
| 4901 | CCTCTCCCCTGAGACCTCT | AGAGGTCTCAGGGGAGAGG |
| 4902 | CTCTCCCCTGAGACCTCTG | CAGAGGTCTCAGGGGAGAG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 4903 | TCTCCCCTGAGACCTCTGC | GCAGAGGTCTCAGGGGAGA |
| 4904 | CTCCCCTGAGACCTCTGCC | GGCAGAGGTCTCAGGGGAG |
| 4905 | TCCCCTGAGACCTCTGCCC | GGGCAGAGGTCTCAGGGGA |
| 4906 | CCCCTGAGACCTCTGCCCT | AGGGCAGAGGTCTCAGGGG |
| 4907 | CCCTGAGACCTCTGCCCTC | GAGGGCAGAGGTCTCAGGG |
| 4908 | CCTGAGACCTCTGCCCTCT | AGAGGGCAGAGGTCTCAGG |
| 4909 | CTGAGACCTCTGCCCTCTC | GAGAGGGCAGAGGTCTCAG |
| 4910 | TGAGACCTCTGCCCTCTCT | AGAGAGGGCAGAGGTCTCA |
| 4911 | GAGACCTCTGCCCTCTCTG | CAGAGAGGGCAGAGGTCTC |
| 4912 | AGACCTCTGCCCTCTCTGC | GCAGAGAGGGCAGAGGTCT |
| 4913 | GACCTCTGCCCTCTCTGCT | AGCAGAGAGGGCAGAGGTC |
| 4914 | ACCTCTGCCCTCTCTGCTC | GAGCAGAGAGGGCAGAGGT |
| 4915 | CCTCTGCCCTCTCTGCTCA | TGAGCAGAGAGGGCAGAGG |
| 4916 | CTCTGCCCTCTCTGCTCAG | CTGAGCAGAGAGGGCAGAG |
| 4917 | TCTGCCCTCTCTGCTCAGC | GCTGAGCAGAGAGGGCAGA |
| 4918 | CTGCCCTCTCTGCTCAGCT | AGCTGAGCAGAGAGGGCAG |
| 4919 | TGCCCTCTCTGCTCAGCTC | GAGCTGAGCAGAGAGGGCA |
| 4920 | GCCCTCTCTGCTCAGCTCT | AGAGCTGAGCAGAGAGGGC |
| 4921 | CCCTCTCTGCTCAGCTCTG | CAGAGCTGAGCAGAGAGGG |
| 4922 | CCTCTCTGCTCAGCTCTGC | GCAGAGCTGAGCAGAGAGG |
| 4923 | CTCTCTGCTCAGCTCTGCC | GGCAGAGCTGAGCAGAGAG |
| 4924 | TCTCTGCTCAGCTCTGCCA | TGGCAGAGCTGAGCAGAGA |
| 4925 | CTCTGCTCAGCTCTGCCAC | GTGGCAGAGCTGAGCAGAG |
| 4926 | TCTGCTCAGCTCTGCCACC | GGTGGCAGAGCTGAGCAGA |
| 4927 | CTGCTCAGCTCTGCCACCA | TGGTGGCAGAGCTGAGCAG |
| 4928 | TGCTCAGCTCTGCCACCAG | CTGGTGGCAGAGCTGAGCA |
| 4929 | GCTCAGCTCTGCCACCAGG | CCTGGTGGCAGAGCTGAGC |
| 4930 | CTCAGCTCTGCCACCAGGG | CCCTGGTGGCAGAGCTGAG |
| 4931 | TCAGCTCTGCCACCAGGGA | TCCCTGGTGGCAGAGCTGA |
| 4932 | CAGCTCTGCCACCAGGGAC | GTCCCTGGTGGCAGAGCTG |
| 4933 | AGCTCTGCCACCAGGGACC | GGTCCCTGGTGGCAGAGCT |
| 4934 | GCTCTGCCACCAGGGACCC | GGGTCCCTGGTGGCAGAGC |
| 4935 | CTCTGCCACCAGGGACCCA | TGGGTCCCTGGTGGCAGAG |
| 4936 | TCTGCCACCAGGGACCCAG | CTGGGTCCCTGGTGGCAGA |
| 4937 | CTGCCACCAGGGACCCAGC | GCTGGGTCCCTGGTGGCAG |
| 4938 | TGCCACCAGGGACCCAGCC | GGCTGGGTCCCTGGTGGCA |
| 4939 | GCCACCAGGGACCCAGCCT | AGGCTGGGTCCCTGGTGGC |
| 4940 | CCACCAGGGACCCAGCCTT | AAGGCTGGGTCCCTGGTGG |
| 4941 | CACCAGGGACCCAGCCTTC | GAAGGCTGGGTCCCTGGTG |
| 4942 | ACCAGGGACCCAGCCTTCC | GGAAGGCTGGGTCCCTGGT |
| 4943 | CCAGGGACCCAGCCTTCCC | GGGAAGGCTGGGTCCCTGG |
| 4944 | CAGGGACCCAGCCTTCCCC | GGGGAAGGCTGGGTCCCTG |
| 4945 | AGGGACCCAGCCTTCCCCC | GGGGGAAGGCTGGGTCCCT |
| 4946 | GGGACCCAGCCTTCCCCCT | AGGGGGAAGGCTGGGTCCC |
| 4947 | GGACCCAGCCTTCCCCCTG | CAGGGGGAAGGCTGGGTCC |
| 4948 | GACCCAGCCTTCCCCCTGA | TCAGGGGAAGGCTGGGTC |
| 4949 | ACCCAGCCTTCCCCCTGAC | GTCAGGGGAAGGCTGGGT |
| 4950 | CCCAGCCTTCCCCCTGACT | AGTCAGGGGAAGGCTGGG |
| 4951 | CCAGCCTTCCCCCTGACTG | CAGTCAGGGGAAGGCTGG |
| 4952 | CAGCCTTCCCCCTGACTGC | GCAGTCAGGGGAAGGCTG |
| 4953 | AGCCTTCCCCCTGACTGCC | GGCAGTCAGGGGAAGGCT |
| 4954 | GCCTTCCCCCTGACTGCCA | TGGCAGTCAGGGGAAGGC |
| 4955 | CCTTCCCCCTGACTGCCAC | GTGGCAGTCAGGGGAAGG |
| 4956 | CTTCCCCCTGACTGCCACC | GGTGGCAGTCAGGGGAAG |
| 4957 | TTCCCCCTGACTGCCACCT | AGGTGGCAGTCAGGGGAA |
| 4958 | TCCCCCTGACTGCCACCTG | CAGGTGGCAGTCAGGGGA |
| 4959 | CCCCCTGACTGCCACCTGC | GCAGGTGGCAGTCAGGGG |
| 4960 | CCCCTGACTGCCACCTGCT | AGCAGGTGGCAGTCAGGGG |
| 4961 | CCCTGACTGCCACCTGCTT | AAGCAGGTGGCAGTCAGGG |
| 4962 | CCTGACTGCCACCTGCTTT | AAAGCAGGTGGCAGTCAGG |
| 4963 | CTGACTGCCACCTGCTTTA | TAAAGCAGGTGGCAGTCAG |
| 4964 | TGACTGCCACCTGCTTTAT | ATAAAGCAGGTGGCAGTCA |
| 4965 | GACTGCCACCTGCTTTATG | CATAAAGCAGGTGGCAGTC |
| 4966 | ACTGCCACCTGCTTTATGC | GCATAAAGCAGGTGGCAGT |
| 4967 | CTGCCACCTGCTTTATGCC | GGCATAAAGCAGGTGGCAG |
| 4968 | TGCCACCTGCTTTATGCCC | GGGCATAAAGCAGGTGGCA |
| 4969 | GCCACCTGCTTTATGCCCA | TGGGCATAAAGCAGGTGGC |
| 4970 | CCACCTGCTTTATGCCCAG | CTGGGCATAAAGCAGGTGG |
| 4971 | CACCTGCTTTATGCCCAGA | TCTGGGCATAAAGCAGGTG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 4972 | ACCTGCTTTATGCCCAGAT | ATCTGGGCATAAAGCAGGT |
| 4973 | CCTGCTTTATGCCCAGATG | CATCTGGGCATAAAGCAGG |
| 4974 | CTGCTTTATGCCCAGATGG | CCATCTGGGCATAAAGCAG |
| 4975 | TGCTTTATGCCCAGATGGA | TCCATCTGGGCATAAAGCA |
| 4976 | GCTTTATGCCCAGATGGAC | GTCCATCTGGGCATAAAGC |
| 4977 | CTTTATGCCCAGATGGACT | AGTCCATCTGGGCATAAAG |
| 4978 | TTTATGCCCAGATGGACTG | CAGTCCATCTGGGCATAAA |
| 4979 | TTATGCCCAGATGGACTGG | CCAGTCCATCTGGGCATAA |
| 4980 | TATGCCCAGATGGACTGGG | CCCAGTCCATCTGGGCATA |
| 4981 | ATGCCCAGATGGACTGGGC | GCCCAGTCCATCTGGGCAT |
| 4982 | TGCCCAGATGGACTGGGCT | AGCCCAGTCCATCTGGGCA |
| 4983 | GCCCAGATGGACTGGGCTG | CAGCCCAGTCCATCTGGGC |
| 4984 | CCCAGATGGACTGGGCTGT | ACAGCCCAGTCCATCTGGG |
| 4985 | CCAGATGGACTGGGCTGTG | CACAGCCCAGTCCATCTGG |
| 4986 | CAGATGGACTGGGCTGTGT | ACACAGCCCAGTCCATCTG |
| 4987 | AGATGGACTGGGCTGTGTT | AACACAGCCCAGTCCATCT |
| 4988 | GATGGACTGGGCTGTGTTC | GAACACAGCCCAGTCCATC |
| 4989 | ATGGACTGGGCTGTGTTCC | GGAACACAGCCCAGTCCAT |
| 4990 | TGGACTGGGCTGTGTTCCA | TGGAACACAGCCCAGTCCA |
| 4991 | GGACTGGGCTGTGTTCCAA | TTGGAACACAGCCCAGTCC |
| 4992 | GACTGGGCTGTGTTCCAAG | CTTGGAACACAGCCCAGTC |
| 4993 | ACTGGGCTGTGTTCCAAGC | GCTTGGAACACAGCCCAGT |
| 4994 | CTGGGCTGTGTTCCAAGCA | TGCTTGGAACACAGCCCAG |
| 4995 | TGGGCTGTGTTCCAAGCAG | CTGCTTGGAACACAGCCCA |
| 4996 | GGGCTGTGTTCCAAGCAGT | ACTGCTTGGAACACAGCCC |
| 4997 | GGCTGTGTTCCAAGCAGTG | CACTGCTTGGAACACAGCC |
| 4998 | GCTGTGTTCCAAGCAGTGA | TCACTGCTTGGAACACAGC |
| 4999 | CTGTGTTCCAAGCAGTGAA | TTCACTGCTTGGAACACAG |
| 5000 | TGTGTTCCAAGCAGTGAAG | CTTCACTGCTTGGAACACA |
| 5001 | GTGTTCCAAGCAGTGAAGG | CCTTCACTGCTTGGAACAC |
| 5002 | TGTTCCAAGCAGTGAAGGT | ACCTTCACTGCTTGGAACA |
| 5003 | GTTCCAAGCAGTGAAGGTG | CACCTTCACTGCTTGGAAC |
| 5004 | TTCCAAGCAGTGAAGGTGG | CCACCTTCACTGCTTGGAA |
| 5005 | TCCAAGCAGTGAAGGTGGC | GCCACCTTCACTGCTTGGA |
| 5006 | CCAAGCAGTGAAGGTGGCC | GGCCACCTTCACTGCTTGG |
| 5007 | CAAGCAGTGAAGGTGGCCG | CGGCCACCTTCACTGCTTG |
| 5008 | AAGCAGTGAAGGTGGCCGT | ACGGCCACCTTCACTGCTT |
| 5009 | AGCAGTGAAGGTGGCCGTG | CACGGCCACCTTCACTGCT |
| 5010 | GCAGTGAAGGTGGCCGTGG | CCACGGCCACCTTCACTGC |
| 5011 | CAGTGAAGGTGGCCGTGGG | CCCACGGCCACCTTCACTG |
| 5012 | AGTGAAGGTGGCCGTGGGG | CCCCACGGCCACCTTCACT |
| 5013 | GTGAAGGTGGCCGTGGGGA | TCCCCACGGCCACCTTCAC |
| 5014 | TGAAGGTGGCCGTGGGGAC | GTCCCCACGGCCACCTTCA |
| 5015 | GAAGGTGGCCGTGGGGACA | TGTCCCCACGGCCACCTTC |
| 5016 | AAGGTGGCCGTGGGGACAT | ATGTCCCCACGGCCACCTT |
| 5017 | AGGTGGCCGTGGGGACATT | AATGTCCCCACGGCCACCT |
| 5018 | GGTGGCCGTGGGGACATTA | TAATGTCCCCACGGCCACC |
| 5019 | GTGGCCGTGGGGACATTAC | GTAATGTCCCCACGGCCAC |
| 5020 | TGGCCGTGGGGACATTACA | TGTAATGTCCCCACGGCCA |
| 5021 | GGCCGTGGGGACATTACAG | CTGTAATGTCCCCACGGCC |
| 5022 | GCCGTGGGGACATTACAGG | CCTGTAATGTCCCCACGGC |
| 5023 | CCGTGGGGACATTACAGGA | TCCTGTAATGTCCCCACGG |
| 5024 | CGTGGGGACATTACAGGAG | CTCCTGTAATGTCCCCACG |
| 5025 | GTGGGGACATTACAGGAGG | CCTCCTGTAATGTCCCCAC |
| 5026 | TGGGGACATTACAGGAGGC | GCCTCCTGTAATGTCCCCA |
| 5027 | GGGGACATTACAGGAGGCC | GGCCTCCTGTAATGTCCCC |
| 5028 | GGGACATTACAGGAGGCCA | TGGCCTCCTGTAATGTCCC |
| 5029 | GGACATTACAGGAGGCCAA | TTGGCCTCCTGTAATGTCC |
| 5030 | GACATTACAGGAGGCCAAA | TTTGGCCTCCTGTAATGTC |
| 5031 | ACATTACAGGAGGCCAAAT | ATTTGGCCTCCTGTAATGT |
| 5032 | CATTACAGGAGGCCAAATA | TATTTGGCCTCCTGTAATG |
| 5033 | ATTACAGGAGGCCAAATAG | CTATTTGGCCTCCTGTAAT |
| 5034 | TTACAGGAGGCCAAATAGA | TCTATTTGGCCTCCTGTAA |
| 5035 | TACAGGAGGCCAAATAGAG | CTCTATTTGGCCTCCTGTA |
| 5036 | ACAGGAGGCCAAATAGAGG | CCTCTATTTGGCCTCCTGT |
| 5037 | CAGGAGGCCAAATAGAGGG | CCCTCTATTTGGCCTCCTG |
| 5038 | AGGAGGCCAAATAGAGGGA | TCCCTCTATTTGGCCTCCT |
| 5039 | GGAGGCCAAATAGAGGGAT | ATCCCTCTATTTGGCCTCC |
| 5040 | GAGGCCAAATAGAGGGATG | CATCCCTCTATTTGGCCTC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 5041 | AGGCCAAATAGAGGGATGC | GCATCCCTCTATTTGGCCT |
| 5042 | GGCCAAATAGAGGGATGCT | AGCATCCCTCTATTTGGCC |
| 5043 | GCCAAATAGAGGGATGCTA | TAGCATCCCTCTATTTGGC |
| 5044 | CCAAATAGAGGGATGCTAG | CTAGCATCCCTCTATTTGG |
| 5045 | CAAATAGAGGGATGCTAGG | CCTAGCATCCCTCTATTTG |
| 5046 | AAATAGAGGGATGCTAGGT | ACCTAGCATCCCTCTATTT |
| 5047 | AATAGAGGGATGCTAGGTG | CACCTAGCATCCCTCTATT |
| 5048 | ATAGAGGGATGCTAGGTGT | ACACCTAGCATCCCTCTAT |
| 5049 | TAGAGGGATGCTAGGTGTC | GACACCTAGCATCCCTCTA |
| 5050 | AGAGGGATGCTAGGTGTCT | AGACACCTAGCATCCCTCT |
| 5051 | GAGGGATGCTAGGTGTCTG | CAGACACCTAGCATCCCTC |
| 5052 | AGGGATGCTAGGTGTCTGG | CCAGACACCTAGCATCCCT |
| 5053 | GGGATGCTAGGTGTCTGGG | CCCAGACACCTAGCATCCC |
| 5054 | GGATGCTAGGTGTCTGGGA | TCCCAGACACCTAGCATCC |
| 5055 | GATGCTAGGTGTCTGGGAT | ATCCCAGACACCTAGCATC |
| 5056 | ATGCTAGGTGTCTGGGATC | GATCCCAGACACCTAGCAT |
| 5057 | TGCTAGGTGTCTGGGATCG | CGATCCCAGACACCTAGCA |
| 5058 | GCTAGGTGTCTGGGATCGG | CCGATCCCAGACACCTAGC |
| 5059 | CTAGGTGTCTGGGATCGGG | CCCGATCCCAGACACCTAG |
| 5060 | TAGGTGTCTGGGATCGGGG | CCCCGATCCCAGACACCTA |
| 5061 | AGGTGTCTGGGATCGGGGT | ACCCCGATCCCAGACACCT |
| 5062 | GGTGTCTGGGATCGGGGTG | CACCCCGATCCCAGACACC |
| 5063 | GTGTCTGGGATCGGGGTGG | CCACCCCGATCCCAGACAC |
| 5064 | TGTCTGGGATCGGGGTGGG | CCCACCCCGATCCCAGACA |
| 5065 | GTCTGGGATCGGGGTGGGG | CCCCACCCCGATCCCAGAC |
| 5066 | TCTGGGATCGGGGTGGGGA | TCCCCACCCCGATCCCAGA |
| 5067 | CTGGGATCGGGGTGGGGAC | GTCCCCACCCCGATCCCAG |
| 5068 | TGGGATCGGGGTGGGGACA | TGTCCCCACCCCGATCCCA |
| 5069 | GGGATCGGGGTGGGGACAG | CTGTCCCCACCCCGATCCC |
| 5070 | GGATCGGGGTGGGGACAGG | CCTGTCCCCACCCCGATCC |
| 5071 | GATCGGGGTGGGGACAGGT | ACCTGTCCCCACCCCGATC |
| 5072 | ATCGGGGTGGGGACAGGTA | TACCTGTCCCCACCCCGAT |
| 5073 | TCGGGGTGGGGACAGGTAG | CTACCTGTCCCCACCCCGA |
| 5074 | CGGGGTGGGGACAGGTAGA | TCTACCTGTCCCCACCCCG |
| 5075 | GGGGTGGGGACAGGTAGAC | GTCTACCTGTCCCCACCCC |
| 5076 | GGGTGGGGACAGGTAGACC | GGTCTACCTGTCCCCACCC |
| 5077 | GGTGGGGACAGGTAGACCA | TGGTCTACCTGTCCCCACC |
| 5078 | GTGGGGACAGGTAGACCAG | CTGGTCTACCTGTCCCCAC |
| 5079 | TGGGGACAGGTAGACCAGG | CCTGGTCTACCTGTCCCCA |
| 5080 | GGGGACAGGTAGACCAGGT | ACCTGGTCTACCTGTCCCC |
| 5081 | GGGACAGGTAGACCAGGTG | CACCTGGTCTACCTGTCCC |
| 5082 | GGACAGGTAGACCAGGTGC | GCACCTGGTCTACCTGTCC |
| 5083 | GACAGGTAGACCAGGTGCT | AGCACCTGGTCTACCTGTC |
| 5084 | ACAGGTAGACCAGGTGCTC | GAGCACCTGGTCTACCTGT |
| 5085 | CAGGTAGACCAGGTGCTCA | TGAGCACCTGGTCTACCTG |
| 5086 | AGGTAGACCAGGTGCTCAG | CTGAGCACCTGGTCTACCT |
| 5087 | GGTAGACCAGGTGCTCAGC | GCTGAGCACCTGGTCTACC |
| 5088 | GTAGACCAGGTGCTCAGCC | GGCTGAGCACCTGGTCTAC |
| 5089 | TAGACCAGGTGCTCAGCCC | GGGCTGAGCACCTGGTCTA |
| 5090 | AGACCAGGTGCTCAGCCCA | TGGGCTGAGCACCTGGTCT |
| 5091 | GACCAGGTGCTCAGCCCAG | CTGGGCTGAGCACCTGGTC |
| 5092 | ACCAGGTGCTCAGCCCAGG | CCTGGGCTGAGCACCTGGT |
| 5093 | CCAGGTGCTCAGCCCAGGC | GCCTGGGCTGAGCACCTGG |
| 5094 | CAGGTGCTCAGCCCAGGCA | TGCCTGGGCTGAGCACCTG |
| 5095 | AGGTGCTCAGCCCAGGCAC | GTGCCTGGGCTGAGCACCT |
| 5096 | GGTGCTCAGCCCAGGCACA | TGTGCCTGGGCTGAGCACC |
| 5097 | GTGCTCAGCCCAGGCACAA | TTGTGCCTGGGCTGAGCAC |
| 5098 | TGCTCAGCCCAGGCACAAC | GTTGTGCCTGGGCTGAGCA |
| 5099 | GCTCAGCCCAGGCACAACT | AGTTGTGCCTGGGCTGAGC |
| 5100 | CTCAGCCCAGGCACAACTT | AAGTTGTGCCTGGGCTGAG |
| 5101 | TCAGCCCAGGCACAACTTC | GAAGTTGTGCCTGGGCTGA |
| 5102 | CAGCCCAGGCACAACTTCA | TGAAGTTGTGCCTGGGCTG |
| 5103 | AGCCCAGGCACAACTTCAG | CTGAAGTTGTGCCTGGGCT |
| 5104 | GCCCAGGCACAACTTCAGC | GCTGAAGTTGTGCCTGGGC |
| 5105 | CCCAGGCACAACTTCAGCA | TGCTGAAGTTGTGCCTGGG |
| 5106 | CCAGGCACAACTTCAGCAG | CTGCTGAAGTTGTGCCTGG |
| 5107 | CAGGCACAACTTCAGCAGG | CCTGCTGAAGTTGTGCCTG |
| 5108 | AGGCACAACTTCAGCAGGG | CCCTGCTGAAGTTGTGCCT |
| 5109 | GGCACAACTTCAGCAGGGG | CCCCTGCTGAAGTTGTGCC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 5110 | GCACAACTTCAGCAGGGGA | TCCCCTGCTGAAGTTGTGC |
| 5111 | GACAACTTCAGCAGGGGAT | ATCCCCTGCTGAAGTTGTG |
| 5112 | ACAACTTCAGCAGGGGATG | CATCCCCTGCTGAAGTTGT |
| 5113 | CAACTTCAGCAGGGGATGG | CCATCCCCTGCTGAAGTTG |
| 5114 | AACTTCAGCAGGGGATGGC | GCCATCCCCTGCTGAAGTT |
| 5115 | ACTTCAGCAGGGGATGGCG | CGCCATCCCCTGCTGAAGT |
| 5116 | CTTCAGCAGGGGATGGCGC | GCGCCATCCCCTGCTGAAG |
| 5117 | TTCAGCAGGGGATGGCGCT | AGCGCCATCCCCTGCTGAA |
| 5118 | TCAGCAGGGGATGGCGCTA | TAGCGCCATCCCCTGCTGA |
| 5119 | CAGCAGGGGATGGCGCTAG | CTAGCGCCATCCCCTGCTG |
| 5120 | AGCAGGGGATGGCGCTAGG | CCTAGCGCCATCCCCTGCT |
| 5121 | GCAGGGGATGGCGCTAGGG | CCCTAGCGCCATCCCCTGC |
| 5122 | CAGGGGATGGCGCTAGGGG | CCCCTAGCGCCATCCCCTG |
| 5123 | AGGGGATGGCGCTAGGGGA | TCCCCTAGCGCCATCCCCT |
| 5124 | GGGGATGGCGCTAGGGGAC | GTCCCCTAGCGCCATCCCC |
| 5125 | GGGATGGCGCTAGGGGACT | AGTCCCCTAGCGCCATCCC |
| 5126 | GGATGGCGCTAGGGGACTT | AAGTCCCCTAGCGCCATCC |
| 5127 | GATGGCGCTAGGGGACTTG | CAAGTCCCCTAGCGCCATC |
| 5128 | ATGGCGCTAGGGGACTTGG | CCAAGTCCCCTAGCGCCAT |
| 5129 | TGGCGCTAGGGGACTTGGG | CCCAAGTCCCCTAGCGCCA |
| 5130 | GGCGCTAGGGGACTTGGGG | CCCCAAGTCCCCTAGCGCC |
| 5131 | GCGCTAGGGGACTTGGGGA | TCCCCAAGTCCCCTAGCGC |
| 5132 | CGCTAGGGGACTTGGGGAT | ATCCCCAAGTCCCCTAGCG |
| 5133 | GCTAGGGGACTTGGGGATT | AATCCCCAAGTCCCCTAGC |
| 5134 | CTAGGGGACTTGGGGATTT | AAATCCCCAAGTCCCCTAG |
| 5135 | TAGGGGACTTGGGGATTTC | GAAATCCCCAAGTCCCCTA |
| 5136 | AGGGGACTTGGGGATTTCT | AGAAATCCCCAAGTCCCCT |
| 5137 | GGGGACTTGGGGATTTCTG | CAGAAATCCCCAAGTCCCC |
| 5138 | GGGACTTGGGGATTTCTGG | CCAGAAATCCCCAAGTCCC |
| 5139 | GGACTTGGGGATTTCTGGT | ACCAGAAATCCCCAAGTCC |
| 5140 | GACTTGGGGATTTCTGGTC | GACCAGAAATCCCCAAGTC |
| 5141 | ACTTGGGGATTTCTGGTCA | TGACCAGAAATCCCCAAGT |
| 5142 | CTTGGGGATTTCTGGTCAA | TTGACCAGAAATCCCCAAG |
| 5143 | TTGGGGATTTCTGGTCAAC | GTTGACCAGAAATCCCCAA |
| 5144 | TGGGGATTTCTGGTCAACC | GGTTGACCAGAAATCCCCA |
| 5145 | GGGGATTTCTGGTCAACCC | GGGTTGACCAGAAATCCCC |
| 5146 | GGGATTTCTGGTCAACCCC | GGGGTTGACCAGAAATCCC |
| 5147 | GGATTTCTGGTCAACCCCA | TGGGGTTGACCAGAAATCC |
| 5148 | GATTTCTGGTCAACCCCAC | GTGGGGTTGACCAGAAATC |
| 5149 | ATTTCTGGTCAACCCCACA | TGTGGGGTTGACCAGAAAT |
| 5150 | TTTCTGGTCAACCCCACAA | TTGTGGGGTTGACCAGAAA |
| 5151 | TTCTGGTCAACCCCACAAG | CTTGTGGGGTTGACCAGAA |
| 5152 | TCTGGTCAACCCCACAAGC | GCTTGTGGGGTTGACCAGA |
| 5153 | CTGGTCAACCCCACAAGCA | TGCTTGTGGGGTTGACCAG |
| 5154 | TGGTCAACCCCACAAGCAC | GTGCTTGTGGGGTTGACCA |
| 5155 | GGTCAACCCCACAAGCACC | GGTGCTTGTGGGGTTGACC |
| 5156 | GTCAACCCCACAAGCACCA | TGGTGCTTGTGGGGTTGAC |
| 5157 | TCAACCCCACAAGCACCAC | GTGGTGCTTGTGGGGTTGA |
| 5158 | CAACCCCACAAGCACCACT | AGTGGTGCTTGTGGGGTTG |
| 5159 | AACCCCACAAGCACCACTC | GAGTGGTGCTTGTGGGGTT |
| 5160 | ACCCCACAAGCACCACTCT | AGAGTGGTGCTTGTGGGGT |
| 5161 | CCCCACAAGCACCACTCTG | CAGAGTGGTGCTTGTGGGG |
| 5162 | CCCACAAGCACCACTCTGG | CCAGAGTGGTGCTTGTGGG |
| 5163 | CCACAAGCACCACTCTGGG | CCCAGAGTGGTGCTTGTGG |
| 5164 | CACAAGCACCACTCTGGGC | GCCCAGAGTGGTGCTTGTG |
| 5165 | ACAAGCACCACTCTGGGCA | TGCCCAGAGTGGTGCTTGT |
| 5166 | CAAGCACCACTCTGGGCAC | GTGCCCAGAGTGGTGCTTG |
| 5167 | AAGCACCACTCTGGGCACA | TGTGCCCAGAGTGGTGCTT |
| 5168 | AGCACCACTCTGGGCACAA | TTGTGCCCAGAGTGGTGCT |
| 5169 | GCACCACTCTGGGCACAAG | CTTGTGCCCAGAGTGGTGC |
| 5170 | CACCACTCTGGGCACAAGC | GCTTGTGCCCAGAGTGGTG |
| 5171 | ACCACTCTGGGCACAAGCA | TGCTTGTGCCCAGAGTGGT |
| 5172 | CCACTCTGGGCACAAGCAG | CTGCTTGTGCCCAGAGTGG |
| 5173 | CACTCTGGGCACAAGCAGG | CCTGCTTGTGCCCAGAGTG |
| 5174 | ACTCTGGGCACAAGCAGGG | CCCTGCTTGTGCCCAGAGT |
| 5175 | CTCTGGGCACAAGCAGGGC | GCCCTGCTTGTGCCCAGAG |
| 5176 | TCTGGGCACAAGCAGGGCA | TGCCCTGCTTGTGCCCAGA |
| 5177 | CTGGGCACAAGCAGGGCAC | GTGCCCTGCTTGTGCCCAG |
| 5178 | TGGGCACAAGCAGGGCACT | AGTGCCCTGCTTGTGCCCA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 5179 | GGGCACAAGCAGGGCACTC | GAGTGCCCTGCTTGTGCCC |
| 5180 | GGCACAAGCAGGGCACTCT | AGAGTGCCCTGCTTGTGCC |
| 5181 | GCACAAGCAGGGCACTCTG | CAGAGTGCCCTGCTTGTGC |
| 5182 | CACAAGCAGGGCACTCTGT | ACAGAGTGCCCTGCTTGTG |
| 5183 | ACAAGCAGGGCACTCTGTT | AACAGAGTGCCCTGCTTGT |
| 5184 | CAAGCAGGGCACTCTGTTC | GAACAGAGTGCCCTGCTTG |
| 5185 | AAGCAGGGCACTCTGTTCC | GGAACAGAGTGCCCTGCTT |
| 5186 | AGCAGGGCACTCTGTTCCC | GGGAACAGAGTGCCCTGCT |
| 5187 | GCAGGGCACTCTGTTCCCC | GGGGAACAGAGTGCCCTGC |
| 5188 | CAGGGCACTCTGTTCCCCT | AGGGGAACAGAGTGCCCTG |
| 5189 | AGGGCACTCTGTTCCCCTC | GAGGGGAACAGAGTGCCCT |
| 5190 | GGGCACTCTGTTCCCCTCC | GGAGGGGAACAGAGTGCCC |
| 5191 | GGCACTCTGTTCCCCTCCC | GGGAGGGGAACAGAGTGCC |
| 5192 | GCACTCTGTTCCCCTCCCC | GGGGAGGGGAACAGAGTGC |
| 5193 | CACTCTGTTCCCCTCCCCC | GGGGGAGGGGAACAGAGTG |
| 5194 | ACTCTGTTCCCCTCCCCCT | AGGGGGAGGGGAACAGAGT |
| 5195 | CTCTGTTCCCCTCCCCCTT | AAGGGGGAGGGGAACAGAG |
| 5196 | TCTGTTCCCCTCCCCCTTA | TAAGGGGGAGGGGAACAGA |
| 5197 | CTGTTCCCCTCCCCCTTAA | TTAAGGGGGAGGGGAACAG |
| 5198 | TGTTCCCCTCCCCCTTAAG | CTTAAGGGGGAGGGGAACA |
| 5199 | GTTCCCCTCCCCCTTAAGC | GCTTAAGGGGGAGGGGAAC |
| 5200 | TTCCCCTCCCCCTTAAGCC | GGCTTAAGGGGGAGGGGAA |
| 5201 | TCCCCTCCCCCTTAAGCCA | TGGCTTAAGGGGGAGGGGA |
| 5202 | CCCCTCCCCCTTAAGCCAA | TTGGCTTAAGGGGGAGGGG |
| 5203 | CCCTCCCCCTTAAGCCAAC | GTTGGCTTAAGGGGGAGGG |
| 5204 | CCTCCCCCTTAAGCCAACA | TGTTGGCTTAAGGGGGAGG |
| 5205 | CTCCCCCTTAAGCCAACAA | TTGTTGGCTTAAGGGGGAG |
| 5206 | TCCCCCTTAAGCCAACAAC | GTTGTTGGCTTAAGGGGGA |
| 5207 | CCCCCTTAAGCCAACAACC | GGTTGTTGGCTTAAGGGGG |
| 5208 | CCCCTTAAGCCAACAACCA | TGGTTGTTGGCTTAAGGGG |
| 5209 | CCCTTAAGCCAACAACCAC | GTGGTTGTTGGCTTAAGGG |
| 5210 | CCTTAAGCCAACAACCACA | TGTGGTTGTTGGCTTAAGG |
| 5211 | CTTAAGCCAACAACCACAG | CTGTGGTTGTTGGCTTAAG |
| 5212 | TTAAGCCAACAACCACAGT | ACTGTGGTTGTTGGCTTAA |
| 5213 | TAAGCCAACAACCACAGTG | CACTGTGGTTGTTGGCTTA |
| 5214 | AAGCCAACAACCACAGTGC | GCACTGTGGTTGTTGGCTT |
| 5215 | AGCCAACAACCACAGTGCC | GGCACTGTGGTTGTTGGCT |
| 5216 | GCCAACAACCACAGTGCCA | TGGCACTGTGGTTGTTGGC |
| 5217 | CCAACAACCACAGTGCCAC | GTGGCACTGTGGTTGTTGG |
| 5218 | CAACAACCACAGTGCCACC | GGTGGCACTGTGGTTGTTG |
| 5219 | AACAACCACAGTGCCACCA | TGGTGGCACTGTGGTTGTT |
| 5220 | ACAACCACAGTGCCACCAA | TTGGTGGCACTGTGGTTGT |
| 5221 | CAACCACAGTGCCACCAAG | CTTGGTGGCACTGTGGTTG |
| 5222 | AACCACAGTGCCACCAAGC | GCTTGGTGGCACTGTGGTT |
| 5223 | ACCACAGTGCCACCAAGCT | AGCTTGGTGGCACTGTGGT |
| 5224 | CCACAGTGCCACCAAGCTC | GAGCTTGGTGGCACTGTGG |
| 5225 | CACAGTGCCACCAAGCTCA | TGAGCTTGGTGGCACTGTG |
| 5226 | ACAGTGCCACCAAGCTCAC | GTGAGCTTGGTGGCACTGT |
| 5227 | CAGTGCCACCAAGCTCACA | TGTGAGCTTGGTGGCACTG |
| 5228 | AGTGCCACCAAGCTCACAC | GTGTGAGCTTGGTGGCACT |
| 5229 | GTGCCACCAAGCTCACACC | GGTGTGAGCTTGGTGGCAC |
| 5230 | TGCCACCAAGCTCACACCT | AGGTGTGAGCTTGGTGGCA |
| 5231 | GCCACCAAGCTCACACCTG | CAGGTGTGAGCTTGGTGGC |
| 5232 | CCACCAAGCTCACACCTGT | ACAGGTGTGAGCTTGGTGG |
| 5233 | CACCAAGCTCACACCTGTC | GACAGGTGTGAGCTTGGTG |
| 5234 | ACCAAGCTCACACCTGTCC | GGACAGGTGTGAGCTTGGT |
| 5235 | CCAAGCTCACACCTGTCCT | AGGACAGGTGTGAGCTTGG |
| 5236 | CAAGCTCACACCTGTCCTT | AAGGACAGGTGTGAGCTTG |
| 5237 | AAGCTCACACCTGTCCTTC | GAAGGACAGGTGTGAGCTT |
| 5238 | AGCTCACACCTGTCCTTCT | AGAAGGACAGGTGTGAGCT |
| 5239 | GCTCACACCTGTCCTTCTC | GAGAAGGACAGGTGTGAGC |
| 5240 | CTCACACCTGTCCTTCTCA | TGAGAAGGACAGGTGTGAG |
| 5241 | TCACACCTGTCCTTCTCAG | CTGAGAAGGACAGGTGTGA |
| 5242 | CACACCTGTCCTTCTCAGG | CCTGAGAAGGACAGGTGTG |
| 5243 | ACACCTGTCCTTCTCAGGC | GCCTGAGAAGGACAGGTGT |
| 5244 | CACCTGTCCTTCTCAGGCT | AGCCTGAGAAGGACAGGTG |
| 5245 | ACCTGTCCTTCTCAGGCTG | CAGCCTGAGAAGGACAGGT |
| 5246 | CCTGTCCTTCTCAGGCTGG | CCAGCCTGAGAAGGACAGG |
| 5247 | CTGTCCTTCTCAGGCTGGC | GCCAGCCTGAGAAGGACAG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 5248 | TGTCCTTCTCAGGCTGGCA | TGCCAGCCTGAGAAGGACA |
| 5249 | GTCCTTCTCAGGCTGGCAT | ATGCCAGCCTGAGAAGGAC |
| 5250 | TCCTTCTCAGGCTGGCATC | GATGCCAGCCTGAGAAGGA |
| 5251 | CCTTCTCAGGCTGGCATCT | AGATGCCAGCCTGAGAAGG |
| 5252 | CTTCTCAGGCTGGCATCTC | GAGATGCCAGCCTGAGAAG |
| 5253 | TTCTCAGGCTGGCATCTCC | GGAGATGCCAGCCTGAGAA |
| 5254 | TCTCAGGCTGGCATCTCCC | GGGAGATGCCAGCCTGAGA |
| 5255 | CTCAGGCTGGCATCTCCCC | GGGGAGATGCCAGCCTGAG |
| 5256 | TCAGGCTGGCATCTCCCCC | GGGGGAGATGCCAGCCTGA |
| 5257 | CAGGCTGGCATCTCCCCCA | TGGGGGAGATGCCAGCCTG |
| 5258 | AGGCTGGCATCTCCCCCAC | GTGGGGGAGATGCCAGCCT |
| 5259 | GGCTGGCATCTCCCCCACC | GGTGGGGGAGATGCCAGCC |
| 5260 | GCTGGCATCTCCCCCACCC | GGGTGGGGGAGATGCCAGC |
| 5261 | CTGGCATCTCCCCCACCCT | AGGGTGGGGGAGATGCCAG |
| 5262 | TGGCATCTCCCCCACCCTG | CAGGGTGGGGGAGATGCCA |
| 5263 | GGCATCTCCCCCACCCTGT | ACAGGGTGGGGGAGATGCC |
| 5264 | GCATCTCCCCCACCCTGTG | CACAGGGTGGGGGAGATGC |
| 5265 | CATCTCCCCCACCCTGTGC | GCACAGGGTGGGGGAGATG |
| 5266 | ATCTCCCCCACCCTGTGCC | GGCACAGGGTGGGGGAGAT |
| 5267 | TCTCCCCCACCCTGTGCCC | GGGCACAGGGTGGGGGAGA |
| 5268 | CTCCCCCACCCTGTGCCCC | GGGGCACAGGGTGGGGGAG |
| 5269 | TCCCCCACCCTGTGCCCCT | AGGGGCACAGGGTGGGGGA |
| 5270 | CCCCCACCCTGTGCCCCTT | AAGGGGCACAGGGTGGGGG |
| 5271 | CCCCACCCTGTGCCCCTTT | AAAGGGGCACAGGGTGGGG |
| 5272 | CCCACCCTGTGCCCCTTTT | AAAAGGGGCACAGGGTGGG |
| 5273 | CCACCCTGTGCCCCTTTTC | GAAAAGGGGCACAGGGTGG |
| 5274 | CACCCTGTGCCCCTTTTCA | TGAAAAGGGGCACAGGGTG |
| 5275 | ACCCTGTGCCCCTTTTCAT | ATGAAAAGGGGCACAGGGT |
| 5276 | CCCTGTGCCCCTTTTCATG | CATGAAAAGGGGCACAGGG |
| 5277 | CCTGTGCCCCTTTTCATGG | CCATGAAAAGGGGCACAGG |
| 5278 | CTGTGCCCCTTTTCATGGT | ACCATGAAAAGGGGCACAG |
| 5279 | TGTGCCCCTTTTCATGGTA | TACCATGAAAAGGGGCACA |
| 5280 | GTGCCCCTTTTCATGGTAC | GTACCATGAAAAGGGGCAC |
| 5281 | TGCCCCTTTTCATGGTACC | GGTACCATGAAAAGGGGCA |
| 5282 | GCCCCTTTTCATGGTACCA | TGGTACCATGAAAAGGGGC |
| 5283 | CCCCTTTTCATGGTACCAG | CTGGTACCATGAAAAGGGG |
| 5284 | CCCTTTTCATGGTACCAGG | CCTGGTACCATGAAAAGGG |
| 5285 | CCTTTTCATGGTACCAGGC | GCCTGGTACCATGAAAAGG |
| 5286 | CTTTTCATGGTACCAGGCC | GGCCTGGTACCATGAAAAG |
| 5287 | TTTTCATGGTACCAGGCCC | GGGCCTGGTACCATGAAAA |
| 5288 | TTTCATGGTACCAGGCCCG | CGGGCCTGGTACCATGAAA |
| 5289 | TTCATGGTACCAGGCCCGC | GCGGGCCTGGTACCATGAA |
| 5290 | TCATGGTACCAGGCCCGCA | TGCGGGCCTGGTACCATGA |
| 5291 | CATGGTACCAGGCCCGCAC | GTGCGGGCCTGGTACCATG |
| 5292 | ATGGTACCAGGCCCGCACT | AGTGCGGGCCTGGTACCAT |
| 5293 | TGGTACCAGGCCCGCACTG | CAGTGCGGGCCTGGTACCA |
| 5294 | GGTACCAGGCCCGCACTGG | CCAGTGCGGGCCTGGTACC |
| 5295 | GTACCAGGCCCGCACTGGG | CCCAGTGCGGGCCTGGTAC |
| 5296 | TACCAGGCCCGCACTGGGG | CCCCAGTGCGGGCCTGGTA |
| 5297 | ACCAGGCCCGCACTGGGGG | CCCCCAGTGCGGGCCTGGT |
| 5298 | CCAGGCCCGCACTGGGGGC | GCCCCCAGTGCGGGCCTGG |
| 5299 | CAGGCCCGCACTGGGGGCA | TGCCCCCAGTGCGGGCCTG |
| 5300 | AGGCCCGCACTGGGGGCAA | TTGCCCCCAGTGCGGGCCT |
| 5301 | GGCCCGCACTGGGGGCAAT | ATTGCCCCCAGTGCGGGCC |
| 5302 | GCCCGCACTGGGGGCAATT | AATTGCCCCCAGTGCGGGC |
| 5303 | CCCGCACTGGGGGCAATTG | CAATTGCCCCCAGTGCGGG |
| 5304 | CCGCACTGGGGGCAATTGA | TCAATTGCCCCCAGTGCGG |
| 5305 | CGCACTGGGGGCAATTGAC | GTCAATTGCCCCCAGTGCG |
| 5306 | GCACTGGGGGCAATTGACT | AGTCAATTGCCCCCAGTGC |
| 5307 | CACTGGGGGCAATTGACTT | AAGTCAATTGCCCCCAGTG |
| 5308 | ACTGGGGGCAATTGACTTC | GAAGTCAATTGCCCCCAGT |
| 5309 | CTGGGGGCAATTGACTTCC | GGAAGTCAATTGCCCCCAG |
| 5310 | TGGGGGCAATTGACTTCCT | AGGAAGTCAATTGCCCCCA |
| 5311 | GGGGGCAATTGACTTCCTC | GAGGAAGTCAATTGCCCCC |
| 5312 | GGGGCAATTGACTTCCTCC | GGAGGAAGTCAATTGCCCC |
| 5313 | GGGCAATTGACTTCCTCCA | TGGAGGAAGTCAATTGCCC |
| 5314 | GGCAATTGACTTCCTCCAA | TTGGAGGAAGTCAATTGCC |
| 5315 | GCAATTGACTTCCTCCAAT | ATTGGAGGAAGTCAATTGC |
| 5316 | CAATTGACTTCCTCCAATC | GATTGGAGGAAGTCAATTG |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 5317 | AATTGACTTCCTCCAATCC | GGATTGGAGGAAGTCAATT |
| 5318 | ATTGACTTCCTCCAATCCC | GGGATTGGAGGAAGTCAAT |
| 5319 | TTGACTTCCTCCAATCCCC | GGGGATTGGAGGAAGTCAA |
| 5320 | TGACTTCCTCCAATCCCCA | TGGGGATTGGAGGAAGTCA |
| 5321 | GACTTCCTCCAATCCCCAC | GTGGGGATTGGAGGAAGTC |
| 5322 | ACTTCCTCCAATCCCCACT | AGTGGGGATTGGAGGAAGT |
| 5323 | CTTCCTCCAATCCCCACTC | GAGTGGGGATTGGAGGAAG |
| 5324 | TTCCTCCAATCCCCACTCC | GGAGTGGGGATTGGAGGAA |
| 5325 | TCCTCCAATCCCCACTCCT | AGGAGTGGGGATTGGAGGA |
| 5326 | CCTCCAATCCCCACTCCTC | GAGGAGTGGGGATTGGAGG |
| 5327 | CTCCAATCCCCACTCCTCC | GGAGGAGTGGGGATTGGAG |
| 5328 | TCCAATCCCCACTCCTCCG | CGGAGGAGTGGGGATTGGA |
| 5329 | CCAATCCCCACTCCTCCGA | TCGGAGGAGTGGGGATTGG |
| 5330 | CAATCCCCACTCCTCCGAG | CTCGGAGGAGTGGGGATTG |
| 5331 | AATCCCCACTCCTCCGAGA | TCTCGGAGGAGTGGGGATT |
| 5332 | ATCCCCACTCCTCCGAGAC | GTCTCGGAGGAGTGGGGAT |
| 5333 | TCCCCACTCCTCCGAGACC | GGTCTCGGAGGAGTGGGGA |
| 5334 | CCCCACTCCTCCGAGACCC | GGGTCTCGGAGGAGTGGGG |
| 5335 | CCCACTCCTCCGAGACCCA | TGGGTCTCGGAGGAGTGGG |
| 5336 | CCACTCCTCCGAGACCCAG | CTGGGTCTCGGAGGAGTGG |
| 5337 | CACTCCTCCGAGACCCAGG | CCTGGGTCTCGGAGGAGTG |
| 5338 | ACTCCTCCGAGACCCAGGA | TCCTGGGTCTCGGAGGAGT |
| 5339 | CTCCTCCGAGACCCAGGAG | CTCCTGGGTCTCGGAGGAG |
| 5340 | TCCTCCGAGACCCAGGAGA | TCTCCTGGGTCTCGGAGGA |
| 5341 | CCTCCGAGACCCAGGAGAC | GTCTCCTGGGTCTCGGAGG |
| 5342 | CTCCGAGACCCAGGAGACA | TGTCTCCTGGGTCTCGGAG |
| 5343 | TCCGAGACCCAGGAGACAA | TTGTCTCCTGGGTCTCGGA |
| 5344 | CCGAGACCCAGGAGACAAA | TTTGTCTCCTGGGTCTCGG |
| 5345 | CGAGACCCAGGAGACAAAC | GTTTGTCTCCTGGGTCTCG |
| 5346 | GAGACCCAGGAGACAAACA | TGTTTGTCTCCTGGGTCTC |
| 5347 | AGACCCAGGAGACAAACAG | CTGTTTGTCTCCTGGGTCT |
| 5348 | GACCCAGGAGACAAACAGC | GCTGTTTGTCTCCTGGGTC |
| 5349 | ACCCAGGAGACAAACAGCC | GGCTGTTTGTCTCCTGGGT |
| 5350 | CCCAGGAGACAAACAGCCC | GGGCTGTTTGTCTCCTGGG |
| 5351 | CCAGGAGACAAACAGCCCT | AGGGCTGTTTGTCTCCTGG |
| 5352 | CAGGAGACAAACAGCCCTT | AAGGGCTGTTTGTCTCCTG |
| 5353 | AGGAGACAAACAGCCCTTC | GAAGGGCTGTTTGTCTCCT |
| 5354 | GGAGACAAACAGCCCTTCC | GGAAGGGCTGTTTGTCTCC |
| 5355 | GAGACAAACAGCCCTTCCT | AGGAAGGGCTGTTTGTCTC |
| 5356 | AGACAAACAGCCCTTCCTT | AAGGAAGGGCTGTTTGTCT |
| 5357 | GACAAACAGCCCTTCCTTG | CAAGGAAGGGCTGTTTGTC |
| 5358 | ACAAACAGCCCTTCCTTGG | CCAAGGAAGGGCTGTTTGT |
| 5359 | CAAACAGCCCTTCCTTGGG | CCCAAGGAAGGGCTGTTTG |
| 5360 | AAACAGCCCTTCCTTGGGG | CCCCAAGGAAGGGCTGTTT |
| 5361 | AACAGCCCTTCCTTGGGGA | TCCCCAAGGAAGGGCTGTT |
| 5362 | ACAGCCCTTCCTTGGGGAA | TTCCCCAAGGAAGGGCTGT |
| 5363 | CAGCCCTTCCTTGGGGAAA | TTTCCCCAAGGAAGGGCTG |
| 5364 | AGCCCTTCCTTGGGGAAAC | GTTTCCCCAAGGAAGGGCT |
| 5365 | GCCCTTCCTTGGGGAAACT | AGTTTCCCCAAGGAAGGGC |
| 5366 | CCCTTCCTTGGGGAAACTT | AAGTTTCCCCAAGGAAGGG |
| 5367 | CCTTCCTTGGGGAAACTTG | CAAGTTTCCCCAAGGAAGG |
| 5368 | CTTCCTTGGGGAAACTTGG | CCAAGTTTCCCCAAGGAAG |
| 5369 | TTCCTTGGGGAAACTTGGG | CCCAAGTTTCCCCAAGGAA |
| 5370 | TCCTTGGGGAAACTTGGGA | TCCCAAGTTTCCCCAAGGA |
| 5371 | CCTTGGGGAAACTTGGGAA | TTCCCAAGTTTCCCCAAGG |
| 5372 | CTTGGGGAAACTTGGGAAT | ATTCCCAAGTTTCCCCAAG |
| 5373 | TTGGGGAAACTTGGGAATC | GATTCCCAAGTTTCCCCAA |
| 5374 | TGGGGAAACTTGGGAATCA | TGATTCCCAAGTTTCCCCA |
| 5375 | GGGGAAACTTGGGAATCAT | ATGATTCCCAAGTTTCCCC |
| 5376 | GGGAAACTTGGGAATCATT | AATGATTCCCAAGTTTCCC |
| 5377 | GGAAACTTGGGAATCATTC | GAATGATTCCCAAGTTTCC |
| 5378 | GAAACTTGGGAATCATTCT | AGAATGATTCCCAAGTTTC |
| 5379 | AAACTTGGGAATCATTCTG | CAGAATGATTCCCAAGTTT |
| 5380 | AACTTGGGAATCATTCTGG | CCAGAATGATTCCCAAGTT |
| 5381 | ACTTGGGAATCATTCTGGC | GCCAGAATGATTCCCAAGT |
| 5382 | CTTGGGAATCATTCTGGCT | AGCCAGAATGATTCCCAAG |
| 5383 | TTGGGAATCATTCTGGCTT | AAGCCAGAATGATTCCCAA |
| 5384 | TGGGAATCATTCTGGCTTA | TAAGCCAGAATGATTCCCA |
| 5385 | GGGAATCATTCTGGCTTAA | TTAAGCCAGAATGATTCCC |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 5386 | GGAATCATTCTGGCTTAAA | TTTAAGCCAGAATGATTCC |
| 5387 | GAATCATTCTGGCTTAAAC | GTTTAAGCCAGAATGATTC |
| 5388 | AATCATTCTGGCTTAAACA | TGTTTAAGCCAGAATGATT |
| 5389 | ATCATTCTGGCTTAAACAA | TTGTTTAAGCCAGAATGAT |
| 5390 | TCATTCTGGCTTAAACAAC | GTTGTTTAAGCCAGAATGA |
| 5391 | CATTCTGGCTTAAACAACA | TGTTGTTTAAGCCAGAATG |
| 5392 | ATTCTGGCTTAAACAACAC | GTGTTGTTTAAGCCAGAAT |
| 5393 | TTCTGGCTTAAACAACACC | GGTGTTGTTTAAGCCAGAA |
| 5394 | TCTGGCTTAAACAACACCT | AGGTGTTGTTTAAGCCAGA |
| 5395 | CTGGCTTAAACAACACCTC | GAGGTGTTGTTTAAGCCAG |
| 5396 | TGGCTTAAACAACACCTCC | GGAGGTGTTGTTTAAGCCA |
| 5397 | GGCTTAAACAACACCTCCT | AGGAGGTGTTGTTTAAGCC |
| 5398 | GCTTAAACAACACCTCCTC | GAGGAGGTGTTGTTTAAGC |
| 5399 | CTTAAACAACACCTCCTCC | GGAGGAGGTGTTGTTTAAG |
| 5400 | TTAAACAACACCTCCTCCT | AGGAGGAGGTGTTGTTTAA |
| 5401 | TAAACAACACCTCCTCCTG | CAGGAGGAGGTGTTGTTTA |
| 5402 | AAACAACACCTCCTCCTGC | GCAGGAGGAGGTGTTGTTT |
| 5403 | AACAACACCTCCTCCTGCT | AGCAGGAGGAGGTGTTGTT |
| 5404 | ACAACACCTCCTCCTGCTG | CAGCAGGAGGAGGTGTTGT |
| 5405 | CAACACCTCCTCCTGCTGC | GCAGCAGGAGGAGGTGTTG |
| 5406 | AACACCTCCTCCTGCTGCT | AGCAGCAGGAGGAGGTGTT |
| 5407 | ACACCTCCTCCTGCTGCTC | GAGCAGCAGGAGGAGGTGT |
| 5408 | CACCTCCTCCTGCTGCTCA | TGAGCAGCAGGAGGAGGTG |
| 5409 | ACCTCCTCCTGCTGCTCAC | GTGAGCAGCAGGAGGAGGT |
| 5410 | CCTCCTCCTGCTGCTCACT | AGTGAGCAGCAGGAGGAGG |
| 5411 | CTCCTCCTGCTGCTCACTC | GAGTGAGCAGCAGGAGGAG |
| 5412 | TCCTCCTGCTGCTCACTCC | GGAGTGAGCAGCAGGAGGA |
| 5413 | CCTCCTGCTGCTCACTCCC | GGGAGTGAGCAGCAGGAGG |
| 5414 | CTCCTGCTGCTCACTCCCG | CGGGAGTGAGCAGCAGGAG |
| 5415 | TCCTGCTGCTCACTCCCGC | GCGGGAGTGAGCAGCAGGA |
| 5416 | CCTGCTGCTCACTCCCGCT | AGCGGGAGTGAGCAGCAGG |
| 5417 | CTGCTGCTCACTCCCGCTG | CAGCGGGAGTGAGCAGCAG |
| 5418 | TGCTGCTCACTCCCGCTGA | TCAGCGGGAGTGAGCAGCA |
| 5419 | GCTGCTCACTCCCGCTGAG | CTCAGCGGGAGTGAGCAGC |
| 5420 | CTGCTCACTCCCGCTGAGC | GCTCAGCGGGAGTGAGCAG |
| 5421 | TGCTCACTCCCGCTGAGCC | GGCTCAGCGGGAGTGAGCA |
| 5422 | GCTCACTCCCGCTGAGCCC | GGGCTCAGCGGGAGTGAGC |
| 5423 | CTCACTCCCGCTGAGCCCA | TGGGCTCAGCGGGAGTGAG |
| 5424 | TCACTCCCGCTGAGCCCAC | GTGGGCTCAGCGGGAGTGA |
| 5425 | CACTCCCGCTGAGCCCACT | AGTGGGCTCAGCGGGAGTG |
| 5426 | ACTCCCGCTGAGCCCACTC | GAGTGGGCTCAGCGGGAGT |
| 5427 | CTCCCGCTGAGCCCACTCT | AGAGTGGGCTCAGCGGGAG |
| 5428 | TCCCGCTGAGCCCACTCTA | TAGAGTGGGCTCAGCGGGA |
| 5429 | CCCGCTGAGCCCACTCTAC | GTAGAGTGGGCTCAGCGGG |
| 5430 | CCGCTGAGCCCACTCTACT | AGTAGAGTGGGCTCAGCGG |
| 5431 | CGCTGAGCCCACTCTACTG | CAGTAGAGTGGGCTCAGCG |
| 5432 | GCTGAGCCCACTCTACTGC | GCAGTAGAGTGGGCTCAGC |
| 5433 | CTGAGCCCACTCTACTGCC | GGCAGTAGAGTGGGCTCAG |
| 5434 | TGAGCCCACTCTACTGCCC | GGGCAGTAGAGTGGGCTCA |
| 5435 | GAGCCCACTCTACTGCCCC | GGGGCAGTAGAGTGGGCTC |
| 5436 | AGCCCACTCTACTGCCCCA | TGGGGCAGTAGAGTGGGCT |
| 5437 | GCCCACTCTACTGCCCCAG | CTGGGGCAGTAGAGTGGGC |
| 5438 | CCCACTCTACTGCCCCAGC | GCTGGGGCAGTAGAGTGGG |
| 5439 | CCACTCTACTGCCCCAGCT | AGCTGGGGCAGTAGAGTGG |
| 5440 | CACTCTACTGCCCCAGCTC | GAGCTGGGGCAGTAGAGTG |
| 5441 | ACTCTACTGCCCCAGCTCC | GGAGCTGGGGCAGTAGAGT |
| 5442 | CTCTACTGCCCCAGCTCCG | CGGAGCTGGGGCAGTAGAG |
| 5443 | TCTACTGCCCCAGCTCCGT | ACGGAGCTGGGGCAGTAGA |
| 5444 | CTACTGCCCCAGCTCCGTT | AACGGAGCTGGGGCAGTAG |
| 5445 | TACTGCCCCAGCTCCGTTT | AAACGGAGCTGGGGCAGTA |
| 5446 | ACTGCCCCAGCTCCGTTTC | GAAACGGAGCTGGGGCAGT |
| 5447 | CTGCCCCAGCTCCGTTTCT | AGAAACGGAGCTGGGGCAG |
| 5448 | TGCCCCAGCTCCGTTTCTA | TAGAAACGGAGCTGGGGCA |
| 5449 | GCCCCAGCTCCGTTTCTAC | GTAGAAACGGAGCTGGGGC |
| 5450 | CCCCAGCTCCGTTTCTACC | GGTAGAAACGGAGCTGGGG |
| 5451 | CCCAGCTCCGTTTCTACCA | TGGTAGAAACGGAGCTGGG |
| 5452 | CCAGCTCCGTTTCTACCAC | GTGGTAGAAACGGAGCTGG |
| 5453 | CAGCTCCGTTTCTACCACC | GGTGGTAGAAACGGAGCTG |
| 5454 | AGCTCCGTTTCTACCACCG | CGGTGGTAGAAACGGAGCT |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 5455 | GCTCCGTTTCTACCACCGC | GCGGTGGTAGAAACGGAGC |
| 5456 | CTCCGTTTCTACCACCGCA | TGCGGTGGTAGAAACGGAG |
| 5457 | TCCGTTTCTACCACCGCAT | ATGCGGTGGTAGAAACGGA |
| 5458 | CCGTTTCTACCACCGCATC | GATGCGGTGGTAGAAACGG |
| 5459 | CGTTTCTACCACCGCATCC | GGATGCGGTGGTAGAAACG |
| 5460 | GTTTCTACCACCGCATCCT | AGGATGCGGTGGTAGAAAC |
| 5461 | TTTCTACCACCGCATCCTC | GAGGATGCGGTGGTAGAAA |
| 5462 | TTCTACCACCGCATCCTCA | TGAGGATGCGGTGGTAGAA |
| 5463 | TCTACCACCGCATCCTCAC | GTGAGGATGCGGTGGTAGA |
| 5464 | CTACCACCGCATCCTCACT | AGTGAGGATGCGGTGGTAG |
| 5465 | TACCACCGCATCCTCACTG | CAGTGAGGATGCGGTGGTA |
| 5466 | ACCACCGCATCCTCACTGG | CCAGTGAGGATGCGGTGGT |
| 5467 | CCACCGCATCCTCACTGGG | CCCAGTGAGGATGCGGTGG |
| 5468 | CACCGCATCCTCACTGGGC | GCCCAGTGAGGATGCGGTG |
| 5469 | ACCGCATCCTCACTGGGCT | AGCCCAGTGAGGATGCGGT |
| 5470 | CCGCATCCTCACTGGGCTC | GAGCCCAGTGAGGATGCGG |
| 5471 | CGCATCCTCACTGGGCTCA | TGAGCCCAGTGAGGATGCG |
| 5472 | GCATCCTCACTGGGCTCAC | GTGAGCCCAGTGAGGATGC |
| 5473 | CATCCTCACTGGGCTCACT | AGTGAGCCCAGTGAGGATG |
| 5474 | ATCCTCACTGGGCTCACTG | CAGTGAGCCCAGTGAGGAT |
| 5475 | TCCTCACTGGGCTCACTGC | GCAGTGAGCCCAGTGAGGA |
| 5476 | CCTCACTGGGCTCACTGCA | TGCAGTGAGCCCAGTGAGG |
| 5477 | CTCACTGGGCTCACTGCAG | CTGCAGTGAGCCCAGTGAG |
| 5478 | TCACTGGGCTCACTGCAGG | CCTGCAGTGAGCCCAGTGA |
| 5479 | CACTGGGCTCACTGCAGGC | GCCTGCAGTGAGCCCAGTG |
| 5480 | ACTGGGCTCACTGCAGGCA | TGCCTGCAGTGAGCCCAGT |
| 5481 | CTGGGCTCACTGCAGGCAT | ATGCCTGCAGTGAGCCCAG |
| 5482 | TGGGCTCACTGCAGGCATG | CATGCCTGCAGTGAGCCCA |
| 5483 | GGGCTCACTGCAGGCATGC | GCATGCCTGCAGTGAGCCC |
| 5484 | GGCTCACTGCAGGCATGCT | AGCATGCCTGCAGTGAGCC |
| 5485 | GCTCACTGCAGGCATGCTG | CAGCATGCCTGCAGTGAGC |
| 5486 | CTCACTGCAGGCATGCTGA | TCAGCATGCCTGCAGTGAG |
| 5487 | TCACTGCAGGCATGCTGAA | TTCAGCATGCCTGCAGTGA |
| 5488 | CACTGCAGGCATGCTGAAC | GTTCAGCATGCCTGCAGTG |
| 5489 | ACTGCAGGCATGCTGAACA | TGTTCAGCATGCCTGCAGT |
| 5490 | CTGCAGGCATGCTGAACAA | TTGTTCAGCATGCCTGCAG |
| 5491 | TGCAGGCATGCTGAACAAG | CTTGTTCAGCATGCCTGCA |
| 5492 | GCAGGCATGCTGAACAAGG | CCTTGTTCAGCATGCCTGC |
| 5493 | CAGGCATGCTGAACAAGGG | CCCTTGTTCAGCATGCCTG |
| 5494 | AGGCATGCTGAACAAGGGG | CCCCTTGTTCAGCATGCCT |
| 5495 | GGCATGCTGAACAAGGGGC | GCCCCTTGTTCAGCATGCC |
| 5496 | GCATGCTGAACAAGGGGCC | GGCCCCTTGTTCAGCATGC |
| 5497 | CATGCTGAACAAGGGGCCT | AGGCCCCTTGTTCAGCATG |
| 5498 | ATGCTGAACAAGGGGCCTC | GAGGCCCCTTGTTCAGCAT |
| 5499 | TGCTGAACAAGGGGCCTCC | GGAGGCCCCTTGTTCAGCA |
| 5500 | GCTGAACAAGGGGCCTCCA | TGGAGGCCCCTTGTTCAGC |
| 5501 | CTGAACAAGGGGCCTCCAA | TTGGAGGCCCCTTGTTCAG |
| 5502 | TGAACAAGGGGCCTCCAAC | GTTGGAGGCCCCTTGTTCA |
| 5503 | GAACAAGGGGCCTCCAACC | GGTTGGAGGCCCCTTGTTC |
| 5504 | AACAAGGGGCCTCCAACCT | AGGTTGGAGGCCCCTTGTT |
| 5505 | ACAAGGGGCCTCCAACCTT | AAGGTTGGAGGCCCCTTGT |
| 5506 | CAAGGGGCCTCCAACCTTC | GAAGGTTGGAGGCCCCTTG |
| 5507 | AAGGGGCCTCCAACCTTCT | AGAAGGTTGGAGGCCCCTT |
| 5508 | AGGGGCCTCCAACCTTCTG | CAGAAGGTTGGAGGCCCCT |
| 5509 | GGGGCCTCCAACCTTCTGC | GCAGAAGGTTGGAGGCCCC |
| 5510 | GGGCCTCCAACCTTCTGCC | GGCAGAAGGTTGGAGGCCC |
| 5511 | GGCCTCCAACCTTCTGCCC | GGGCAGAAGGTTGGAGGCC |
| 5512 | GCCTCCAACCTTCTGCCCT | AGGGCAGAAGGTTGGAGGC |
| 5513 | CCTCCAACCTTCTGCCCTC | GAGGGCAGAAGGTTGGAGG |
| 5514 | CTCCAACCTTCTGCCCTCC | GGAGGGCAGAAGGTTGGAG |
| 5515 | TCCAACCTTCTGCCCTCCT | AGGAGGGCAGAAGGTTGGA |
| 5516 | CCAACCTTCTGCCCTCCTG | CAGGAGGGCAGAAGGTTGG |
| 5517 | CAACCTTCTGCCCTCCTGC | GCAGGAGGGCAGAAGGTTG |
| 5518 | AACCTTCTGCCCTCCTGCC | GGCAGGAGGGCAGAAGGTT |
| 5519 | ACCTTCTGCCCTCCTGCCA | TGGCAGGAGGGCAGAAGGT |
| 5520 | CCTTCTGCCCTCCTGCCAA | TTGGCAGGAGGGCAGAAGG |
| 5521 | CTTCTGCCCTCCTGCCAAA | TTTGGCAGGAGGGCAGAAG |
| 5522 | TTCTGCCCTCCTGCCAAAA | TTTTGGCAGGAGGGCAGAA |
| 5523 | TCTGCCCTCCTGCCAAAAG | CTTTTGGCAGGAGGGCAGA |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X - 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 5524 | CTGCCCTCCTGCCAAAAGA | TCTTTTGGCAGGAGGGCAG |
| 5525 | TGCCCTCCTGCCAAAAGAT | ATCTTTTGGCAGGAGGGCA |
| 5526 | GCCCTCCTGCCAAAAGATC | GATCTTTTGGCAGGAGGGC |
| 5527 | CCCTCCTGCCAAAAGATCT | AGATCTTTTGGCAGGAGGG |
| 5528 | CCTCCTGCCAAAAGATCTG | CAGATCTTTTGGCAGGAGG |
| 5529 | CTCCTGCCAAAAGATCTGG | CCAGATCTTTTGGCAGGAG |
| 5530 | TCCTGCCAAAAGATCTGGG | CCCAGATCTTTTGGCAGGA |
| 5531 | CCTGCCAAAAGATCTGGGG | CCCCAGATCTTTTGGCAGG |
| 5532 | CTGCCAAAAGATCTGGGGA | TCCCCAGATCTTTTGGCAG |
| 5533 | TGCCAAAAGATCTGGGGAG | CTCCCCAGATCTTTTGGCA |
| 5534 | GCCAAAAGATCTGGGGAGT | ACTCCCCAGATCTTTTGGC |
| 5535 | CCAAAAGATCTGGGGAGTG | CACTCCCCAGATCTTTTGG |
| 5536 | CAAAAGATCTGGGGAGTGT | ACACTCCCCAGATCTTTTG |
| 5537 | AAAAGATCTGGGGAGTGTG | CACACTCCCCAGATCTTTT |
| 5538 | AAAGATCTGGGGAGTGTGA | TCACACTCCCCAGATCTTT |
| 5539 | AAGATCTGGGGAGTGTGAG | CTCACACTCCCCAGATCTT |
| 5540 | AGATCTGGGGAGTGTGAGG | CCTCACACTCCCCAGATCT |
| 5541 | GATCTGGGGAGTGTGAGGA | TCCTCACACTCCCCAGATC |
| 5542 | ATCTGGGGAGTGTGAGGAG | CTCCTCACACTCCCCAGAT |
| 5543 | TCTGGGGAGTGTGAGGAGA | TCTCCTCACACTCCCCAGA |
| 5544 | CTGGGGAGTGTGAGGAGAG | CTCTCCTCACACTCCCCAG |
| 5545 | TGGGGAGTGTGAGGAGAGG | CCTCTCCTCACACTCCCCA |
| 5546 | GGGGAGTGTGAGGAGAGGG | CCCTCTCCTCACACTCCCC |
| 5547 | GGGAGTGTGAGGAGAGGGT | ACCCTCTCCTCACACTCCC |
| 5548 | GGAGTGTGAGGAGAGGGTG | CACCCTCTCCTCACACTCC |
| 5549 | GAGTGTGAGGAGAGGGTGG | CCACCCTCTCCTCACACTC |
| 5550 | AGTGTGAGGAGAGGGTGGC | GCCACCCTCTCCTCACACT |
| 5551 | GTGTGAGGAGAGGGTGGCA | TGCCACCCTCTCCTCACAC |
| 5552 | TGTGAGGAGAGGGTGGCAT | ATGCCACCCTCTCCTCACA |
| 5553 | GTGAGGAGAGGGTGGCATC | GATGCCACCCTCTCCTCAC |
| 5554 | TGAGGAGAGGGTGGCATCA | TGATGCCACCCTCTCCTCA |
| 5555 | GAGGAGAGGGTGGCATCAG | CTGATGCCACCCTCTCCTC |
| 5556 | AGGAGAGGGTGGCATCAGG | CCTGATGCCACCCTCTCCT |
| 5557 | GGAGAGGGTGGCATCAGGA | TCCTGATGCCACCCTCTCC |
| 5558 | GAGAGGGTGGCATCAGGAG | CTCCTGATGCCACCCTCTC |
| 5559 | AGAGGGTGGCATCAGGAGC | GCTCCTGATGCCACCCTCT |
| 5560 | GAGGGTGGCATCAGGAGCT | AGCTCCTGATGCCACCCTC |
| 5561 | AGGGTGGCATCAGGAGCTG | CAGCTCCTGATGCCACCCT |
| 5562 | GGGTGGCATCAGGAGCTGC | GCAGCTCCTGATGCCACCC |
| 5563 | GGTGGCATCAGGAGCTGCT | AGCAGCTCCTGATGCCACC |
| 5564 | GTGGCATCAGGAGCTGCTC | GAGCAGCTCCTGATGCCAC |
| 5565 | TGGCATCAGGAGCTGCTCA | TGAGCAGCTCCTGATGCCA |
| 5566 | GGCATCAGGAGCTGCTCAG | CTGAGCAGCTCCTGATGCC |
| 5567 | GCATCAGGAGCTGCTCAGG | CCTGAGCAGCTCCTGATGC |
| 5568 | CATCAGGAGCTGCTCAGGC | GCCTGAGCAGCTCCTGATG |
| 5569 | ATCAGGAGCTGCTCAGGCT | AGCCTGAGCAGCTCCTGAT |
| 5570 | TCAGGAGCTGCTCAGGCTT | AAGCCTGAGCAGCTCCTGA |
| 5571 | CAGGAGCTGCTCAGGCTTG | CAAGCCTGAGCAGCTCCTG |
| 5572 | AGGAGCTGCTCAGGCTTGG | CCAAGCCTGAGCAGCTCCT |
| 5573 | GGAGCTGCTCAGGCTTGGC | GCCAAGCCTGAGCAGCTCC |
| 5574 | GAGCTGCTCAGGCTTGGCG | CGCCAAGCCTGAGCAGCTC |
| 5575 | AGCTGCTCAGGCTTGGCGG | CCGCCAAGCCTGAGCAGCT |
| 5576 | GCTGCTCAGGCTTGGCGGA | TCCGCCAAGCCTGAGCAGC |
| 5577 | CTGCTCAGGCTTGGCGGAG | CTCCGCCAAGCCTGAGCAG |
| 5578 | TGCTCAGGCTTGGCGGAGG | CCTCCGCCAAGCCTGAGCA |
| 5579 | GCTCAGGCTTGGCGGAGGG | CCCTCCGCCAAGCCTGAGC |
| 5580 | CTCAGGCTTGGCGGAGGGA | TCCCTCCGCCAAGCCTGAG |
| 5581 | TCAGGCTTGGCGGAGGGAG | CTCCCTCCGCCAAGCCTGA |
| 5582 | CAGGCTTGGCGGAGGGAGC | GCTCCCTCCGCCAAGCCTG |
| 5583 | AGGCTTGGCGGAGGGAGCG | CGCTCCCTCCGCCAAGCCT |
| 5584 | GGCTTGGCGGAGGGAGCGG | CCGCTCCCTCCGCCAAGCC |
| 5585 | GCTTGGCGGAGGGAGCGGC | GCCGCTCCCTCCGCCAAGC |
| 5586 | CTTGGCGGAGGGAGCGGCA | TGCCGCTCCCTCCGCCAAG |
| 5587 | TTGGCGGAGGGAGCGGCAT | ATGCCGCTCCCTCCGCCAA |
| 5588 | TGGCGGAGGGAGCGGCATG | CATGCCGCTCCCTCCGCCA |
| 5589 | GGCGGAGGGAGCGGCATGG | CCATGCCGCTCCCTCCGCC |
| 5590 | GCGGAGGGAGCGGCATGGG | CCCATGCCGCTCCCTCCGC |
| 5591 | CGGAGGGAGCGGCATGGGC | GCCCATGCCGCTCCCTCCG |
| 5592 | GGAGGGAGCGGCATGGGCG | CGCCCATGCCGCTCCCTCC |

TABLE 1-continued cDNA Human Hairless 19-mer Target Sequences and
Complement Referenced to NM_005144-
*Homo sapiens* hairless homolog (mouse) (HR),
transcript variant 1, complete mRNA (1-5699 bp).
(SEQ ID NO: for Sense equals (2X − 1) SEQ ID
NO: for Antisense equals (2X), (e.g. where
X = 1 Sense has SEQ ID NO: 1 and Antisense
has SEQ ID NO: 2)

| X | Sense (5'-3') | Antisense (5'-3') |
|---|---|---|
| 5593 | GAGGGAGCGGCATGGGCGA | TCGCCCATGCCGCTCCCTC |
| 5594 | AGGGAGCGGCATGGGCGAT | ATCGCCCATGCCGCTCCCT |
| 5595 | GGGAGCGGCATGGGCGATG | CATCGCCCATGCCGCTCCC |
| 5596 | GGAGCGGCATGGGCGATGT | ACATCGCCCATGCCGCTCC |
| 5597 | GAGCGGCATGGGCGATGTC | GACATCGCCCATGCCGCTC |
| 5598 | AGCGGCATGGGCGATGTCA | TGACATCGCCCATGCCGCT |
| 5599 | GCGGCATGGGCGATGTCAC | GTGACATCGCCCATGCCGC |
| 5600 | CGGCATGGGCGATGTCACT | AGTGACATCGCCCATGCCG |
| 5601 | GGCATGGGCGATGTCACTC | GAGTGACATCGCCCATGCC |
| 5602 | GCATGGGCGATGTCACTCA | TGAGTGACATCGCCCATGC |
| 5603 | CATGGGCGATGTCACTCAG | CTGAGTGACATCGCCCATG |
| 5604 | ATGGGCGATGTCACTCAGC | GCTGAGTGACATCGCCCAT |
| 5605 | TGGGCGATGTCACTCAGCC | GGCTGAGTGACATCGCCCA |
| 5606 | GGGCGATGTCACTCAGCCC | GGGCTGAGTGACATCGCCC |
| 5607 | GGCGATGTCACTCAGCCCC | GGGGCTGAGTGACATCGCC |
| 5608 | GCGATGTCACTCAGCCCCT | AGGGGCTGAGTGACATCGC |
| 5609 | CGATGTCACTCAGCCCCTT | AAGGGGCTGAGTGACATCG |
| 5610 | GATGTCACTCAGCCCCTTC | GAAGGGGCTGAGTGACATC |
| 5611 | ATGTCACTCAGCCCCTTCC | GGAAGGGGCTGAGTGACAT |
| 5612 | TGTCACTCAGCCCCTTCCC | GGGAAGGGGCTGAGTGACA |
| 5613 | GTCACTCAGCCCCTTCCCG | CGGGAAGGGGCTGAGTGAC |
| 5614 | TCACTCAGCCCCTTCCCGG | CCGGGAAGGGGCTGAGTGA |
| 5615 | CACTCAGCCCCTTCCCGGT | ACCGGGAAGGGGCTGAGTG |
| 5616 | ACTCAGCCCCTTCCCGGTC | GACCGGGAAGGGGCTGAGT |
| 5617 | CTCAGCCCCTTCCCGGTCC | GGACCGGGAAGGGGCTGAG |
| 5618 | TCAGCCCCTTCCCGGTCCG | CGGACCGGGAAGGGGCTGA |
| 5619 | CAGCCCCTTCCCGGTCCGC | GCGGACCGGGAAGGGGCTG |
| 5620 | AGCCCCTTCCCGGTCCGCC | GGCGGACCGGGAAGGGGCT |
| 5621 | GCCCCTTCCCGGTCCGCCC | GGGCGGACCGGGAAGGGGC |
| 5622 | CCCCTTCCCGGTCCGCCCG | CGGGCGGACCGGGAAGGGG |
| 5623 | CCCTTCCCGGTCCGCCCGC | GCGGGCGGACCGGGAAGGG |
| 5624 | CCTTCCCGGTCCGCCCGCT | AGCGGGCGGACCGGGAAGG |
| 5625 | CTTCCCGGTCCGCCCGCTT | AAGCGGGCGGACCGGGAAG |
| 5626 | TTCCCGGTCCGCCCGCTTC | GAAGCGGGCGGACCGGGAA |
| 5627 | TCCCGGTCCGCCCGCTTCC | GGAAGCGGGCGGACCGGGA |
| 5628 | CCCGGTCCGCCCGCTTCCC | GGGAAGCGGGCGGACCGGG |
| 5629 | CCGGTCCGCCCGCTTCCCT | AGGGAAGCGGGCGGACCGG |
| 5630 | CGGTCCGCCCGCTTCCCTC | GAGGGAAGCGGGCGGACCG |
| 5631 | GGTCCGCCCGCTTCCCTCC | GGAGGGAAGCGGGCGGACC |
| 5632 | GTCCGCCCGCTTCCCTCCT | AGGAGGGAAGCGGGCGGAC |
| 5633 | TCCGCCCGCTTCCCTCCTT | AAGGAGGGAAGCGGGCGGA |
| 5634 | CCGCCCGCTTCCCTCCTTC | GAAGGAGGGAAGCGGGCGG |
| 5635 | CGCCCGCTTCCCTCCTTCA | TGAAGGAGGGAAGCGGGCG |
| 5636 | GCCCGCTTCCCTCCTTCAT | ATGAAGGAGGGAAGCGGGC |
| 5637 | CCCGCTTCCCTCCTTCATG | CATGAAGGAGGGAAGCGGG |
| 5638 | CCGCTTCCCTCCTTCATGA | TCATGAAGGAGGGAAGCGG |
| 5639 | CGCTTCCCTCCTTCATGAT | ATCATGAAGGAGGGAAGCG |
| 5640 | GCTTCCCTCCTTCATGATT | AATCATGAAGGAGGGAAGC |
| 5641 | CTTCCCTCCTTCATGATTT | AAATCATGAAGGAGGGAAG |
| 5642 | TTCCCTCCTTCATGATTTC | GAAATCATGAAGGAGGGAA |
| 5643 | TCCCTCCTTCATGATTTCC | GGAAATCATGAAGGAGGGA |
| 5644 | CCCTCCTTCATGATTTCCA | TGGAAATCATGAAGGAGGG |
| 5645 | CCTCCTTCATGATTTCCAT | ATGGAAATCATGAAGGAGG |
| 5646 | CTCCTTCATGATTTCCATT | AATGGAAATCATGAAGGAG |
| 5647 | TCCTTCATGATTTCCATTA | TAATGGAAATCATGAAGGA |
| 5648 | CCTTCATGATTTCCATTAA | TTAATGGAAATCATGAAGG |
| 5649 | CTTCATGATTTCCATTAAA | TTTAATGGAAATCATGAAG |
| 5650 | TTCATGATTTCCATTAAAG | CTTTAATGGAAATCATGAA |
| 5651 | TCATGATTTCCATTAAAGT | ACTTTAATGGAAATCATGA |
| 5652 | CATGATTTCCATTAAAGTC | GACTTTAATGGAAATCATG |
| 5653 | ATGATTTCCATTAAAGTCT | AGACTTTAATGGAAATCAT |
| 5654 | TGATTTCCATTAAAGTCTG | CAGACTTTAATGGAAATCA |
| 5655 | GATTTCCATTAAAGTCTGT | ACAGACTTTAATGGAAATC |
| 5656 | ATTTCCATTAAAGTCTGTT | AACAGACTTTAATGGAAAT |
| 5657 | TTTCCATTAAAGTCTGTTG | CAACAGACTTTAATGGAAA |
| 5658 | TTCCATTAAAGTCTGTTGT | ACAACAGACTTTAATGGAA |
| 5659 | TCCATTAAAGTCTGTTGTT | AACAACAGACTTTAATGGA |
| 5660 | CCATTAAAGTCTGTTGTTT | AAACAACAGACTTTAATGG |
| 5661 | CATTAAAGTCTGTTGTTTT | AAAACAACAGACTTTAATG |

TABLE 1-continued cDNA Human Hairless 19-mer Target Sequences and Complement Referenced to NM_005144- *Homo sapiens* hairless homolog (mouse) (HR), transcript variant 1, complete mRNA (1-5699 bp). (SEQ ID NO: for Sense equals (2X − 1) SEQ ID NO: for Antisense equals (2X), (e.g. where X = 1 Sense has SEQ ID NO: 1 and Antisense has SEQ ID NO: 2)

| X | Sense (5'-3') | Antisense (5'-3') |
|---|---|---|
| 5662 | ATTAAAGTCTGTTGTTTTG | CAAAACAACAGACTTTAAT |
| 5663 | TTAAAGTCTGTTGTTTTGT | ACAAAACAACAGACTTTAA |
| 5664 | TAAAGTCTGTTGTTTTGTG | CACAAAACAACAGACTTTA |

TABLE 2

Human and Mouse Hairless Polymorphisms

| Gene | mRNA (bp) | Accession number | Position (nt) | From/To | Comments |
|---|---|---|---|---|---|
| Human Hairless | 5699 | NM_005144 | 867 | C/A | *Homo sapiens* hairless homolog (mouse) (HR), transcript variant 1, mRNA |
|  |  |  | 1330 | T/G |  |
|  |  |  | 1677 | C/T |  |
|  |  |  | 1686 | C/T |  |
|  |  |  | 2437 | C/A |  |
|  |  |  | 2491 | G/A |  |
|  |  |  | 2671 | G/A |  |
|  |  |  | 2672 | C/T |  |
|  |  |  | 2786 | T/C |  |
|  |  |  | 3058 | T/C |  |
|  |  |  | 3064 | A/G |  |
|  |  |  | 3208 | C/T |  |
|  |  |  | 3253 | G/A |  |
|  |  |  | 3340 | G/A |  |
|  |  |  | 3695 | C/T |  |
|  |  |  | 3812 | A/T |  |
|  |  |  | 3851 | C/T |  |
|  |  |  | 3854 | C/T |  |
|  |  |  | 4545 | A/G |  |
|  |  |  | 4715 | C/G |  |
|  |  |  | 4820 | C/A |  |
| Mouse hairless | 5599 | NM_021877 | 402 | A/G | *Mus musculus* hairless (hr), mRNA |
|  |  |  | 535 | C/A |  |
|  |  |  | 1603 | G/A |  |
|  |  |  | 1681 | A/G |  |
|  |  |  | 1895 | C/T |  |
|  |  |  | 2251 | G/A |  |
|  |  |  | 2482 | T/C |  |
|  |  |  | 2569 | T/C |  |
|  |  |  | 2917 | T/C |  |
|  |  |  | 3232 | C/T |  |
|  |  |  | 3371 | A/T |  |
|  |  |  | 3610 | C/A |  |
|  |  |  | 4065 | T/G |  |

TABLE 3

Exemplary siRNA target sequences in mammalian hairless mRNAs (shown as cDNA sequences)

| Start | Sequence | Region |
|---|---|---|
| Mouse (*Mus musculus*) hairless (hr), mRNA, NM_021877 | | |
| 2023 | GCAGGAGACACCGGAGACAATCATA (SEQ ID NO: 11373) | ORF |
| 2495 | GGACTCTTCAACACCCACTGGAGAT (SEQ ID NO: 11374) | ORF |

TABLE 3-continued

Exemplary siRNA target sequences in mammalian hairless mRNAs (shown as cDNA sequences)

| Start | Sequence | Region |
|---|---|---|
| 2713 | CCAAGTCTGGGCCAAGTTTGACATT (SEQ ID NO: 11375) | ORF |
| 2831 | CCACAACCTTCCTGCAATGGAGATT (SEQ ID NO: 11376) | ORF |
| 2844 | GCAATGGAGATTCCAATCGGACCAA (SEQ ID NO: 11377) | ORF |
| 3042 | CCAGTGATGACCGCATTACCAACAT (SEQ ID NO: 11378) | ORF |
| 3085 | GCAGGTAGTAGAACGGAAGATCCAA (SEQ ID NO: 11379) | ORF |
| 3750 | CCTGGTATCGAGCACAGAAAGATTT (SEQ ID NO: 11380) | ORF |
| 4068 | GCACAATCAGTGTCACTCAGCACTT (SEQ ID NO: 11381) | ORF |
| *Homo sapiens* hairless homolog (mouse) (HR), transcript variant 1, mRNA, NM_005144 | | |
| 2151 | GCGGAACCTGGGTTGTTTGGCTTAA (SEQ ID NO: 11382) | ORF |
| 2831 | GGACACATCGATAGGGAACAAGGAT (SEQ ID NO: 11383) | ORF |
| 3626 | CCCAACTCCACAACCTTCCTGCAAT (SEQ ID NO: 11384) | ORF |
| 3796 | GCCATGAGCGAATACACATGGCCTT (SEQ ID NO: 11385) | ORF |
| 4092 | CCTGTGTTGGTGTCAGGGATCCAAA (SEQ ID NO: 11386) | ORF |
| Rat (*Rattus norvegicus*) hairless (hr) mRNA, NM-024364 | | |
| 913 | CCAAGATTCTAGAGCGAGCTCCCTT (SEQ ID NO: 11387) | ORF |
| 2045 | GGATTCCTGTGCCACTTCTGAGGAA (SEQ ID NO: 11388) | ORF |
| 2601 | CCACAACTTTCCTGCAATGGAGATT (SEQ ID NO: 11389) | ORF |
| 2614 | GCAATGGAGATTCCAATCGGACCAA (SEQ ID NO: 11390) | ORF |
| 2729 | GCTGCTAGCCTCTACAGCTGTCAAA (SEQ ID NO: 11391) | ORF |
| 2765 | GCATGAGCGGATTCACATGGCCTTT (SEQ ID NO: 11392) | ORF |
| 2812 | CCAGTGATGACCGCATTACCAACAT (SEQ ID NO: 11393) | ORF |
| 2855 | GCAGGTAGTAGAACGGAAGATCCAA (SEQ ID NO: 11394) | ORF |
| 3520 | CCTGGTACCGAGCACAGAAAGATTT (SEQ ID NO: 11395) | ORF |
| 3838 | GCACAATCAGTGTCACTCAGCACTT (SEQ ID NO: 11396) | ORF |

TABLE 3-continued

Exemplary siRNA target sequences in mammalian hairless mRNAs (shown as cDNA sequences)

| Start | Sequence | Region |
|---|---|---|
| Monkey (*Macaca mulatto*) hairless mRNA, complete cds, AF_361864 | | |
| 1152 | GCACTCGGAGCAGTTTGAATGTCCA (SEQ ID NO: 11397) | ORF |
| 1344 | GGACACATCGATAGGGAACAAGGAG (SEQ ID NO: 11398) | ORF |
| 2025 | GCACCAGGTCTGGGTCAAGTTTGAT (SEQ ID NO: 11399) | ORF |
| 2172 | CCACAGGACCAAGAGCATCAAAGAG (SEQ ID NO: 113400) | ORF |
| 2605 | CCTGTGTTGGTGTCAGGGATCCAAA (SEQ ID NO: 11401) | ORF |
| Pig (*Sus scrofa*) hairless mRNA, partical cds, AY279972 | | |
| 490 | CAGATATGGGCAGCCTATGGTGTGA (SEQ ID NO: 11402) | ORF |
| 918 | CCTGGTAAGCACAGTGAGCATCACT (SEQ ID NO: 11403) | ORF |
| 921 | GGTAAGCACAGTGAGCATCACTCAG (SEQ ID NO: 11404) | ORF |
| 926 | GCACAGTGAGCATCACTCAGCACTT (SEQ ID NO: 11405) | ORF |
| 927 | CACAGTGAGCATCACTCAGCACTTC (SEQ ID NO: 11406) | ORF |
| Sheep (*Ovis aries*) hairless mRNA, partial cds, AY130969 | | |
| 366 | GGATCCTGAGCATAATGGTGGCCAT (SEQ ID NO: 11407) | ORF |
| 1140 | GCTTACTCGACACTCTGAGCAGTTT (SEQ ID NO: 11408) | ORF |
| 1798 | GGACTGTTCAATACCCACTGGAGAT (SEQ ID NO: 11409) | ORF |
| 1967 | CCCAGTTTGTCTCCAGTCAGCCTTT (SEQ ID NO: 11410) | ORF |
| 2016 | CCAGGTCTGGGTCAAGTTTGACATT (SEQ ID NO: 11411) | ORF |

TABLE 4

Human hairless target/siRNA sequences human hairless NM_005144

| Loop: | 475-615 |
|---|---|
| Loop: | 651-752 |
| Loop: | 951-1137 |
| Loop: | 1968-2183 |
| Loop: | 2348-2568 |
| Loop: | 2769-2806 |
| Loop: | 3024-3365 |
| Loop: | 3069-3277 |
| Loop: | 4577-4698 |
| Loop: | 3605-3724 |
| Loop: | 4861-5079 |
| Loop: | 310-436 |
| Loop: | 1953-2248 |
| Loop: | 919-1265 |
| Loop: | 4286-4465 |
| Loop: | 2373-2555 |
| Loop: | 4853-5284 |
| Loop: | 1916-2288 |
| Loop: | 2739-2863 |
| Loop: | 4874-5043 |
| Loop: | 3047-3318 |
| Loop: | 959-1123 |
| Loop: | 4477-4534 |
| Loop: | 871-1302 |
| Loop: | 4325-4459 |
| Loop: | 4913-5029 |
| Loop: | 940-1166 |
| Loop: | 1946-2277 |
| Loop: | 4086-4199 |
| Loop: | 5093-5247 |

TABLE 5

Mouse hairless target/siRNA sequences mouse hairless NM_021877

| Loop: | 318-523 |
|---|---|
| Loop: | 2422-2459 |
| Loop: | 1870-1913 |
| Loop: | 5010-5089 |
| Loop: | 3614-3736 |
| Loop: | 20-23 |
| Loop: | 1048-1390 |
| Loop: | 1122-1304 |
| Loop: | 3434-3550 |
| Loop: | 3257-3337 |
| Loop: | 4272-4504 |
| Loop: | 3009-3024 |
| Loop: | 4879-4967 |
| Loop: | 668-845 |
| Loop: | 4050-4222 |
| Loop: | 1702-1800 |
| Loop: | 3364-3567 |
| Loop: | 1015-1029 |
| Loop: | 4730-4780 |
| Loop: | 1712-1792 |
| Loop: | 4540-4566 |
| Loop: | 4070-4135 |
| Loop: | 1220-1260 |
| Loop: | 3579-3701 |
| Loop: | 445-459 |
| Loop: | 3491-3516 |
| Loop: | 205-238 |
| Loop: | 1691-1926 |
| Loop: | 2320-2337 |
| Loop: | 896-951 |
| Loop: | 2212-2244 |
| Loop: | 5156-5179 |
| Loop: | 2850-3948 |
| Loop: | 1141-1201 |
| Loop: | 2588-2648 |
| Loop: | 403-518 |
| Loop: | 3370-3407 |
| Loop: | 412-510 |
| Loop: | 4517-4594 |
| Loop: | 659-871 |
| Loop: | 1087-1103 |
| Loop: | 1600-1624 |
| Loop: | 4389-4461 |
| Loop: | 3423-3561 |
| Loop: | 713-812 |
| Loop: | 176-302 |
| Loop: | 1073-1336 |
| Loop: | 675-837 |
| Loop: | 4395-4417 |
| Loop: | 1082-1316 |
| Loop: | 4152-4215 |
| Loop: | 2877-2944 |

SEQUENCE LISTING (11413 sequences)

SEQ ID NO: 1 - DNA, 19 bp, Artificial Sequence
  Description of Artificial Sequence: Chemically synthesized oligonucleotide
tctcccgggagccactccc

SEQ ID NO: 2 - DNA, 19 bp, Artificial Sequence
  Description of Artificial Sequence: Chemically synthesized oligonucleotide
gggagtggctcccgggaga

SEQ ID NO: 3 - DNA, 19 bp, Artificial Sequence
  Description of Artificial Sequence: Chemically synthesized oligonucleotide
ctcccgggagccactccca

SEQ ID NO: 4 - DNA, 19 bp, Artificial Sequence
  Description of Artificial Sequence: Chemically synthesized oligonucleotide
tgggagtggctcccgggag

SEQ ID NO: 5 - DNA, 19 bp, Artificial Sequence
  Description of Artificial Sequence: Chemically synthesized oligonucleotide
tcccgggagccactcccat

SEQ ID NO: 6 - DNA, 19 bp, Artificial Sequence
  Description of Artificial Sequence: Chemically synthesized oligonucleotide
atgggagtggctcccggga

SEQ ID NO: 7 - DNA, 19 bp, Artificial Sequence
  Description of Artificial Sequence: Chemically synthesized oligonucleotide
cccgggagccactcccatg

SEQ ID NO: 8 - DNA, 19 bp, Artificial Sequence
  Description of Artificial Sequence: Chemically synthesized oligonucleotide
catgggagtggctcccggg

SEQ ID NO: 9 - DNA, 19 bp, Artificial Sequence
  Description of Artificial Sequence: Chemically synthesized oligonucleotide
ccgggagccactcccatgg

SEQ ID NO: 10 - DNA, 19 bp, Artificial Sequence
  Description of Artificial Sequence: Chemically synthesized oligonucleotide
ccatgggagtggctcccgg

SEQ ID NO: 11 - DNA, 19 bp, Artificial Sequence
  Description of Artificial Sequence: Chemically synthesized oligonucleotide
cgggagccactcccatggg

SEQ ID NO: 12 - DNA, 19 bp, Artificial Sequence
  Description of Artificial Sequence: Chemically synthesized oligonucleotide
cccatgggagtggctcccg

SEQ ID NO: 13 - DNA, 19 bp, Artificial Sequence
  Description of Artificial Sequence: Chemically synthesized oligonucleotide
gggagccactcccatgggc

SEQ ID NO: 14 - DNA, 19 bp, Artificial Sequence
  Description of Artificial Sequence: Chemically synthesized oligonucleotide
gcccatgggagtggctccc

SEQ ID NO: 15 - DNA, 19 bp, Artificial Sequence
  Description of Artificial Sequence: Chemically synthesized oligonucleotide
ggagccactcccatgggcg

SEQ ID NO: 16 - DNA, 19 bp, Artificial Sequence
  Description of Artificial Sequence: Chemically synthesized oligonucleotide
cgcccatgggagtggctcc

SEQ ID NO: 17 - DNA, 19 bp, Artificial Sequence
  Description of Artificial Sequence: Chemically synthesized oligonucleotide
gagccactcccatgggcgc

SEQ ID NO: 18 - DNA, 19 bp, Artificial Sequence
  Description of Artificial Sequence: Chemically synthesized oligonucleotide
gcgcccatgggagtggctc

SEQ ID NO: 19 - DNA, 19 bp, Artificial Sequence
  Description of Artificial Sequence: Chemically synthesized oligonucleotide
agccactcccatgggcgcc

SEQ ID NO: 20 - DNA, 19 bp, Artificial Sequence
  Description of Artificial Sequence: Chemically synthesized oligonucleotide
ggcgcccatgggagtggct

SEQ ID NO: 21 - DNA, 19 bp, Artificial Sequence
  Description of Artificial Sequence: Chemically synthesized oligonucleotide
gccactcccatgggcgcct

SEQ ID NO: 22 - DNA, 19 bp, Artificial Sequence
  Description of Artificial Sequence: Chemically synthesized oligonucleotide
aggcgcccatgggagtggc

SEQ ID NO: 23 - DNA, 19 bp, Artificial Sequence
  Description of Artificial Sequence: Chemically synthesized oligonucleotide
ccactcccatgggcgcctc

SEQ ID NO: 24 - DNA, 19 bp, Artificial Sequence
  Description of Artificial Sequence: Chemically synthesized oligonucleotide
gaggcgcccatgggagtgg

SEQ ID NO: 25 - DNA, 19 bp, Artificial Sequence
  Description of Artificial Sequence: Chemically synthesized oligonucleotide
cactcccatgggcgcctct

SEQ ID NO: 26 - DNA, 19 bp, Artificial Sequence
  Description of Artificial Sequence: Chemically synthesized oligonucleotide
agaggcgcccatgggagtg

SEQ ID NO: 27 - DNA, 19 bp, Artificial Sequence
  Description of Artificial Sequence: Chemically synthesized oligonucleotide
actcccatgggcgcctctc

SEQ ID NO: 28 - DNA, 19 bp, Artificial Sequence
  Description of Artificial Sequence: Chemically synthesized oligonucleotide
gagaggcgcccatgggagt

SEQ ID NO: 29 - DNA, 19 bp, Artificial Sequence
  Description of Artificial Sequence: Chemically synthesized oligonucleotide
ctcccatgggcgcctctcc

SEQ ID NO: 30 - DNA, 19 bp, Artificial Sequence
  Description of Artificial Sequence: Chemically synthesized oligonucleotide
ggagaggcgcccatgggag

SEQ ID NO: 31 - DNA, 19 bp, Artificial Sequence
  Description of Artificial Sequence: Chemically synthesized oligonucleotide
tcccatgggcgcctctcca

SEQ ID NO: 32 - DNA, 19 bp, Artificial Sequence
  Description of Artificial Sequence: Chemically synthesized oligonucleotide
tggagaggcgcccatggga

SEQ ID NO: 33 - DNA, 19 bp, Artificial Sequence
  Description of Artificial Sequence: Chemically synthesized oligonucleotide
cccatgggcgcctctccag

SEQ ID NO: 34 - DNA, 19 bp, Artificial Sequence
  Description of Artificial Sequence: Chemically synthesized oligonucleotide
ctggagaggcgcccatggg

SEQ ID NO: 35 - DNA, 19 bp, Artificial Sequence
  Description of Artificial Sequence: Chemically synthesized oligonucleotide
ccatgggcgcctctccagc

SEQ ID NO: 36 - DNA, 19 bp, Artificial Sequence
  Description of Artificial Sequence: Chemically synthesized oligonucleotide
gctggagaggcgcccatgg

SEQ ID NO: 37 - DNA, 19 bp, Artificial Sequence
  Description of Artificial Sequence: Chemically synthesized oligonucleotide
catgggcgcctctccagcc

SEQ ID NO: 38 - DNA, 19 bp, Artificial Sequence
  Description of Artificial Sequence: Chemically synthesized oligonucleotide
ggctggagaggcgcccatg

SEQ ID NO: 39 - DNA, 19 bp, Artificial Sequence
  Description of Artificial Sequence: Chemically synthesized oligonucleotide
atgggcgcctctccagccc

SEQ ID NO: 40 - DNA, 19 bp, Artificial Sequence
  Description of Artificial Sequence: Chemically synthesized oligonucleotide
gggctggagaggcgcccat

SEQ ID NO: 41 - DNA, 19 bp, Artificial Sequence
  Description of Artificial Sequence: Chemically synthesized oligonucleotide
tgggcgcctctccagcccc

SEQ ID NO: 42 - DNA, 19 bp, Artificial Sequence
  Description of Artificial Sequence: Chemically synthesized oligonucleotide
ggggctggagaggcgccca

SEQ ID NO: 43 - DNA, 19 bp, Artificial Sequence
  Description of Artificial Sequence: Chemically synthesized oligonucleotide
gggcgcctctccagcccct

SEQ ID NO: 44 - DNA, 19 bp, Artificial Sequence
  Description of Artificial Sequence: Chemically synthesized oligonucleotide
aggggctggagaggcgccc

SEQ ID NO: 45 - DNA, 19 bp, Artificial Sequence
  Description of Artificial Sequence: Chemically synthesized oligonucleotide
ggcgcctctccagcccctg

SEQ ID NO: 46 - DNA, 19 bp, Artificial Sequence
  Description of Artificial Sequence: Chemically synthesized oligonucleotide
caggggctggagaggcgcc

SEQ ID NO: 47 - DNA, 19 bp, Artificial Sequence
  Description of Artificial Sequence: Chemically synthesized oligonucleotide
gcgcctctccagcccctgg

SEQ ID NO: 48 - DNA, 19 bp, Artificial Sequence
  Description of Artificial Sequence: Chemically synthesized oligonucleotide
ccaggggctggagaggcgc

SEQ ID NO: 49 - DNA, 19 bp, Artificial Sequence
  Description of Artificial Sequence: Chemically synthesized oligonucleotide
cgcctctccagcccctggc

SEQ ID NO: 50 - DNA, 19 bp, Artificial Sequence
  Description of Artificial Sequence: Chemically synthesized oligonucleotide
gccaggggctggagaggcg

SEQ ID NO: 51 - DNA, 19 bp, Artificial Sequence
  Description of Artificial Sequence: Chemically synthesized oligonucleotide
gcctctccagcccctggcc

SEQ ID NO: 52 - DNA, 19 bp, Artificial Sequence
  Description of Artificial Sequence: Chemically synthesized oligonucleotide
ggccaggggctggagaggc

SEQ ID NO: 53 - DNA, 19 bp, Artificial Sequence
  Description of Artificial Sequence: Chemically synthesized oligonucleotide
cctctccagcccctggcct

SEQ ID NO: 54 - DNA, 19 bp, Artificial Sequence
  Description of Artificial Sequence: Chemically synthesized oligonucleotide
aggccaggggctggagagg

SEQ ID NO: 55 - DNA, 19 bp, Artificial Sequence
  Description of Artificial Sequence: Chemically synthesized oligonucleotide
ctctccagcccctggcctg

SEQ ID NO: 56 - DNA, 19 bp, Artificial Sequence
  Description of Artificial Sequence: Chemically synthesized oligonucleotide
caggccaggggctggagag

SEQ ID NO: 57 - DNA, 19 bp, Artificial Sequence
  Description of Artificial Sequence: Chemically synthesized oligonucleotide
tctccagcccctggcctgg

SEQ ID NO: 58 - DNA, 19 bp, Artificial Sequence
  Description of Artificial Sequence: Chemically synthesized oligonucleotide
ccaggccaggggctggaga

SEQ ID NO: 59 - DNA, 19 bp, Artificial Sequence
  Description of Artificial Sequence: Chemically synthesized oligonucleotide
ctccagcccctggcctgga

SEQ ID NO: 60 - DNA, 19 bp, Artificial Sequence
  Description of Artificial Sequence: Chemically synthesized oligonucleotide
tccaggccaggggctggag

SEQ ID NO: 61 - DNA, 19 bp, Artificial Sequence
  Description of Artificial Sequence: Chemically synthesized oligonucleotide
tccagcccctggcctggaa

SEQ ID NO: 62 - DNA, 19 bp, Artificial Sequence
  Description of Artificial Sequence: Chemically synthesized oligonucleotide
ttccaggccaggggctgga

SEQ ID NO: 63 - DNA, 19 bp, Artificial Sequence
  Description of Artificial Sequence: Chemically synthesized oligonucleotide
ccagcccctggcctggaag

SEQ ID NO: 64 - DNA, 19 bp, Artificial Sequence
  Description of Artificial Sequence: Chemically synthesized oligonucleotide
cttccaggccaggggctgg

SEQ ID NO: 65 - DNA, 19 bp, Artificial Sequence
  Description of Artificial Sequence: Chemically synthesized oligonucleotide
cagcccctggcctggaagc

SEQ ID NO: 66 - DNA, 19 bp, Artificial Sequence
  Description of Artificial Sequence: Chemically synthesized oligonucleotide
gcttccaggccaggggctg

SEQ ID NO: 67 - DNA, 19 bp, Artificial Sequence
  Description of Artificial Sequence: Chemically synthesized oligonucleotide
agcccctggcctggaagca

SEQ ID NO: 68 - DNA, 19 bp, Artificial Sequence
  Description of Artificial Sequence: Chemically synthesized oligonucleotide
tgcttccaggccaggggct

SEQ ID NO: 69 - DNA, 19 bp, Artificial Sequence
  Description of Artificial Sequence: Chemically synthesized oligonucleotide
gcccctggcctggaagcac

SEQ ID NO: 70 - DNA, 19 bp, Artificial Sequence
  Description of Artificial Sequence: Chemically synthesized oligonucleotide
gtgcttccaggccaggggc

SEQ ID NO: 71 - DNA, 19 bp, Artificial Sequence
  Description of Artificial Sequence: Chemically synthesized oligonucleotide
cccctggcctggaagcacc

SEQ ID NO: 72 - DNA, 19 bp, Artificial Sequence
  Description of Artificial Sequence: Chemically synthesized oligonucleotide
ggtgcttccaggccagggg

SEQ ID NO: 73 - DNA, 19 bp, Artificial Sequence
  Description of Artificial Sequence: Chemically synthesized oligonucleotide
ccctggcctggaagcacca

SEQ ID NO: 74 - DNA, 19 bp, Artificial Sequence
  Description of Artificial Sequence: Chemically synthesized oligonucleotide
tggtgcttccaggccaggg

SEQ ID NO: 75 - DNA, 19 bp, Artificial Sequence
  Description of Artificial Sequence: Chemically synthesized oligonucleotide
cctggcctggaagcaccag

SEQ ID NO: 76 - DNA, 19 bp, Artificial Sequence
  Description of Artificial Sequence: Chemically synthesized oligonucleotide
ctggtgcttccaggccagg

SEQ ID NO: 77 - DNA, 19 bp, Artificial Sequence
  Description of Artificial Sequence: Chemically synthesized oligonucleotide
ctggcctggaagcaccagg

SEQ ID NO: 78 - DNA, 19 bp, Artificial Sequence
  Description of Artificial Sequence: Chemically synthesized oligonucleotide
cctggtgcttccaggccag

SEQ ID NO: 79 - DNA, 19 bp, Artificial Sequence
  Description of Artificial Sequence: Chemically synthesized oligonucleotide
tggcctggaagcaccagga

SEQ ID NO: 80 - DNA, 19 bp, Artificial Sequence
  Description of Artificial Sequence: Chemically synthesized oligonucleotide
tcctggtgcttccaggcca

SEQ ID NO: 81 - DNA, 19 bp, Artificial Sequence
  Description of Artificial Sequence: Chemically synthesized oligonucleotide
ggcctggaagcaccaggaa

SEQ ID NO: 82 - DNA, 19 bp, Artificial Sequence
  Description of Artificial Sequence: Chemically synthesized oligonucleotide
ttcctggtgcttccaggcc

SEQ ID NO: 83 - DNA, 19 bp, Artificial Sequence
  Description of Artificial Sequence: Chemically synthesized oligonucleotide
gcctggaagcaccaggaac

SEQ ID NO: 84 - DNA, 19 bp, Artificial Sequence
  Description of Artificial Sequence: Chemically synthesized oligonucleotide
gttcctggtgcttccaggc

SEQ ID NO: 85 - DNA, 19 bp, Artificial Sequence
  Description of Artificial Sequence: Chemically synthesized oligonucleotide
cctggaagcaccaggaacc

SEQ ID NO: 86 - DNA, 19 bp, Artificial Sequence
  Description of Artificial Sequence: Chemically synthesized oligonucleotide
ggttcctggtgcttccagg

SEQ ID NO: 87 - DNA, 19 bp, Artificial Sequence
  Description of Artificial Sequence: Chemically synthesized oligonucleotide
ctggaagcaccaggaaccc

SEQ ID NO: 88 - DNA, 19 bp, Artificial Sequence
  Description of Artificial Sequence: Chemically synthesized oligonucleotide
gggttcctggtgcttccag

SEQ ID NO: 89 - DNA, 19 bp, Artificial Sequence
  Description of Artificial Sequence: Chemically synthesized oligonucleotide
tggaagcaccaggaaccct

SEQ ID NO: 90 - DNA, 19 bp, Artificial Sequence
  Description of Artificial Sequence: Chemically synthesized oligonucleotide
agggttcctggtgcttcca

SEQ ID NO: 91 - DNA, 19 bp, Artificial Sequence
  Description of Artificial Sequence: Chemically synthesized oligonucleotide
ggaagcaccaggaaccctg

SEQ ID NO: 92 - DNA, 19 bp, Artificial Sequence
  Description of Artificial Sequence: Chemically synthesized oligonucleotide
cagggttcctggtgcttcc

SEQ ID NO: 93 - DNA, 19 bp, Artificial Sequence
  Description of Artificial Sequence: Chemically synthesized oligonucleotide
gaagcaccaggaaccctgg

SEQ ID NO: 94 - DNA, 19 bp, Artificial Sequence
  Description of Artificial Sequence: Chemically synthesized oligonucleotide
ccagggttcctggtgcttc

SEQ ID NO: 95 - DNA, 19 bp, Artificial Sequence
  Description of Artificial Sequence: Chemically synthesized oligonucleotide
aagcaccaggaaccctggg

SEQ ID NO: 96 - DNA, 19 bp, Artificial Sequence
  Description of Artificial Sequence: Chemically synthesized oligonucleotide
cccagggttcctggtgctt

SEQ ID NO: 97 - DNA, 19 bp, Artificial Sequence
  Description of Artificial Sequence: Chemically synthesized oligonucleotide
agcaccaggaaccctgggg

SEQ ID NO: 98 - DNA, 19 bp, Artificial Sequence
  Description of Artificial Sequence: Chemically synthesized oligonucleotide
ccccagggttcctggtgct

SEQ ID NO: 99 - DNA, 19 bp, Artificial Sequence
  Description of Artificial Sequence: Chemically synthesized oligonucleotide
gcaccaggaaccctgggga

SEQ ID NO: 100 - DNA, 19 bp, Artificial Sequence
  Description of Artificial Sequence: Chemically synthesized oligonucleotide
tccccagggttcctggtgc

SEQ ID NO: 101 - DNA, 19 bp, Artificial Sequence
  Description of Artificial Sequence: Chemically synthesized oligonucleotide
caccaggaaccctggggat

SEQ ID NO: 102 - DNA, 19 bp, Artificial Sequence
  Description of Artificial Sequence: Chemically synthesized oligonucleotide
atccccagggttcctggtg

SEQ ID NO: 103 - DNA, 19 bp, Artificial Sequence
  Description of Artificial Sequence: Chemically synthesized oligonucleotide
accaggaaccctggggatg

SEQ ID NO: 104 - DNA, 19 bp, Artificial Sequence
  Description of Artificial Sequence: Chemically synthesized oligonucleotide
catccccagggttcctggt

SEQ ID NO: 105 - DNA, 19 bp, Artificial Sequence
  Description of Artificial Sequence: Chemically synthesized oligonucleotide
ccaggaaccctggggatgg

SEQ ID NO: 106 - DNA, 19 bp, Artificial Sequence
  Description of Artificial Sequence: Chemically synthesized oligonucleotide
ccatccccagggttcctgg

SEQ ID NO: 107 - DNA, 19 bp, Artificial Sequence
  Description of Artificial Sequence: Chemically synthesized oligonucleotide
caggaaccctggggatggg

SEQ ID NO: 108 - DNA, 19 bp, Artificial Sequence
  Description of Artificial Sequence: Chemically synthesized oligonucleotide
cccatccccagggttcctg

SEQ ID NO: 109 - DNA, 19 bp, Artificial Sequence
  Description of Artificial Sequence: Chemically synthesized oligonucleotide
aggaaccctggggatgggg

SEQ ID NO: 110 - DNA, 19 bp, Artificial Sequence
  Description of Artificial Sequence: Chemically synthesized oligonucleotide
ccccatccccagggttcct

SEQ ID NO: 111 - DNA, 19 bp, Artificial Sequence
  Description of Artificial Sequence: Chemically synthesized oligonucleotide
ggaaccctggggatggggc

SEQ ID NO: 112 - DNA, 19 bp, Artificial Sequence
  Description of Artificial Sequence: Chemically synthesized oligonucleotide
gccccatccccagggttcc

SEQ ID NO: 113 - DNA, 19 bp, Artificial Sequence
  Description of Artificial Sequence: Chemically synthesized oligonucleotide
gaaccctggggatggggca

SEQ ID NO: 114 - DNA, 19 bp, Artificial Sequence
  Description of Artificial Sequence: Chemically synthesized oligonucleotide
tgccccatccccagggttc

SEQ ID NO: 115 - DNA, 19 bp, Artificial Sequence
  Description of Artificial Sequence: Chemically synthesized oligonucleotide
aaccctggggatggggcag

SEQ ID NO: 116 - DNA, 19 bp, Artificial Sequence
  Description of Artificial Sequence: Chemically synthesized oligonucleotide
ctgccccatccccagggtt

SEQ ID NO: 117 - DNA, 19 bp, Artificial Sequence
  Description of Artificial Sequence: Chemically synthesized oligonucleotide
accctggggatggggcaga

SEQ ID NO: 118 - DNA, 19 bp, Artificial Sequence
  Description of Artificial Sequence: Chemically synthesized oligonucleotide
tctgccccatccccagggt

SEQ ID NO: 119 - DNA, 19 bp, Artificial Sequence
  Description of Artificial Sequence: Chemically synthesized oligonucleotide
ccctggggatggggcagac

SEQ ID NO: 120 - DNA, 19 bp, Artificial Sequence
  Description of Artificial Sequence: Chemically synthesized oligonucleotide
gtctgccccatccccaggg

SEQ ID NO: 121 - DNA, 19 bp, Artificial Sequence
  Description of Artificial Sequence: Chemically synthesized oligonucleotide
cctggggatggggcagacc

SEQ ID NO: 122 - DNA, 19 bp, Artificial Sequence
  Description of Artificial Sequence: Chemically synthesized oligonucleotide
ggtctgccccatccccagg

SEQ ID NO: 123 - DNA, 19 bp, Artificial Sequence
  Description of Artificial Sequence: Chemically synthesized oligonucleotide
ctggggatggggcagaccc

SEQ ID NO: 124 - DNA, 19 bp, Artificial Sequence
  Description of Artificial Sequence: Chemically synthesized oligonucleotide
gggtctgccccatccccag

SEQ ID NO: 125 - DNA, 19 bp, Artificial Sequence
  Description of Artificial Sequence: Chemically synthesized oligonucleotide
tggggatggggcagaccct

SEQ ID NO: 126 - DNA, 19 bp, Artificial Sequence
  Description of Artificial Sequence: Chemically synthesized oligonucleotide
agggtctgccccatcccca

SEQ ID NO: 127 - DNA, 19 bp, Artificial Sequence
  Description of Artificial Sequence: Chemically synthesized oligonucleotide
ggggatggggcagaccctc

SEQ ID NO: 128 - DNA, 19 bp, Artificial Sequence
  Description of Artificial Sequence: Chemically synthesized oligonucleotide
gagggtctgccccatcccc

SEQ ID NO: 129 - DNA, 19 bp, Artificial Sequence
  Description of Artificial Sequence: Chemically synthesized oligonucleotide
gggatggggcagaccctca

SEQ ID NO: 130 - DNA, 19 bp, Artificial Sequence
  Description of Artificial Sequence: Chemically synthesized oligonucleotide
tgagggtctgccccatccc

SEQ ID NO: 131 - DNA, 19 bp, Artificial Sequence
  Description of Artificial Sequence: Chemically synthesized oligonucleotide
ggatggggcagaccctcac

SEQ ID NO: 132 - DNA, 19 bp, Artificial Sequence
  Description of Artificial Sequence: Chemically synthesized oligonucleotide
gtgagggtctgccccatcc

SEQ ID NO: 133 - DNA, 19 bp, Artificial Sequence
  Description of Artificial Sequence: Chemically synthesized oligonucleotide
gatggggcagaccctcaca

SEQ ID NO: 134 - DNA, 19 bp, Artificial Sequence
  Description of Artificial Sequence: Chemically synthesized oligonucleotide
tgtgagggtctgccccatc

SEQ ID NO: 135 - DNA, 19 bp, Artificial Sequence
  Description of Artificial Sequence: Chemically synthesized oligonucleotide
atggggcagaccctcacag

SEQ ID NO: 136 - DNA, 19 bp, Artificial Sequence
  Description of Artificial Sequence: Chemically synthesized oligonucleotide
ctgtgagggtctgccccat

SEQ ID NO: 137 - DNA, 19 bp, Artificial Sequence
  Description of Artificial Sequence: Chemically synthesized oligonucleotide
tggggcagaccctcacagc

SEQ ID NO: 138 - DNA, 19 bp, Artificial Sequence
  Description of Artificial Sequence: Chemically synthesized oligonucleotide
gctgtgagggtctgcccca

SEQ ID NO: 139 - DNA, 19 bp, Artificial Sequence
  Description of Artificial Sequence: Chemically synthesized oligonucleotide
ggggcagaccctcacagcc

SEQ ID NO: 140 - DNA, 19 bp, Artificial Sequence
  Description of Artificial Sequence: Chemically synthesized oligonucleotide
ggctgtgagggtctgcccc

SEQ ID NO: 141 - DNA, 19 bp, Artificial Sequence
  Description of Artificial Sequence: Chemically synthesized oligonucleotide
gggcagaccctcacagccc

SEQ ID NO: 142 - DNA, 19 bp, Artificial Sequence
  Description of Artificial Sequence: Chemically synthesized oligonucleotide
gggctgtgagggtctgccc

SEQ ID NO: 143 - DNA, 19 bp, Artificial Sequence
  Description of Artificial Sequence: Chemically synthesized oligonucleotide
ggcagaccctcacagcccg

SEQ ID NO: 144 - DNA, 19 bp, Artificial Sequence
  Description of Artificial Sequence: Chemically synthesized oligonucleotide
cgggctgtgagggtctgcc

SEQ ID NO: 145 - DNA, 19 bp, Artificial Sequence
  Description of Artificial Sequence: Chemically synthesized oligonucleotide
gcagaccctcacagcccgg

SEQ ID NO: 146 - DNA, 19 bp, Artificial Sequence
  Description of Artificial Sequence: Chemically synthesized oligonucleotide
ccgggctgtgagggtctgc

SEQ ID NO: 147 - DNA, 19 bp, Artificial Sequence
  Description of Artificial Sequence: Chemically synthesized oligonucleotide
cagaccctcacagcccggg

SEQ ID NO: 148 - DNA, 19 bp, Artificial Sequence
  Description of Artificial Sequence: Chemically synthesized oligonucleotide
cccgggctgtgagggtctg

SEQ ID NO: 149 - DNA, 19 bp, Artificial Sequence
  Description of Artificial Sequence: Chemically synthesized oligonucleotide
agaccctcacagcccgggg

SEQ ID NO: 150 - DNA, 19 bp, Artificial Sequence
  Description of Artificial Sequence: Chemically synthesized oligonucleotide
ccccgggctgtgagggtct

SEQ ID NO: 151 - DNA, 19 bp, Artificial Sequence
  Description of Artificial Sequence: Chemically synthesized oligonucleotide
gaccctcacagcccggggt

SEQ ID NO: 152 - DNA, 19 bp, Artificial Sequence
  Description of Artificial Sequence: Chemically synthesized oligonucleotide
accccgggctgtgagggtc

SEQ ID NO: 153 - DNA, 19 bp, Artificial Sequence
  Description of Artificial Sequence: Chemically synthesized oligonucleotide
accctcacagcccggggtc

SEQ ID NO: 154 - DNA, 19 bp, Artificial Sequence
  Description of Artificial Sequence: Chemically synthesized oligonucleotide
gaccccgggctgtgagggt

SEQ ID NO: 155 - DNA, 19 bp, Artificial Sequence
  Description of Artificial Sequence: Chemically synthesized oligonucleotide
ccctcacagcccggggtct

SEQ ID NO: 156 - DNA, 19 bp, Artificial Sequence
  Description of Artificial Sequence: Chemically synthesized oligonucleotide
agaccccgggctgtgaggg

SEQ ID NO: 157 - DNA, 19 bp, Artificial Sequence
  Description of Artificial Sequence: Chemically synthesized oligonucleotide
cctcacagcccggggtctg

SEQ ID NO: 158 - DNA, 19 bp, Artificial Sequence
  Description of Artificial Sequence: Chemically synthesized oligonucleotide
cagaccccgggctgtgagg

SEQ ID NO: 159 - DNA, 19 bp, Artificial Sequence
  Description of Artificial Sequence: Chemically synthesized oligonucleotide
ctcacagcccggggtctgg

SEQ ID NO: 160 - DNA, 19 bp, Artificial Sequence
  Description of Artificial Sequence: Chemically synthesized oligonucleotide
ccagaccccgggctgtgag

SEQ ID NO: 161 - DNA, 19 bp, Artificial Sequence
  Description of Artificial Sequence: Chemically synthesized oligonucleotide
tcacagcccggggtctgga

SEQ ID NO: 162 - DNA, 19 bp, Artificial Sequence
  Description of Artificial Sequence: Chemically synthesized oligonucleotide
tccagaccccgggctgtga

SEQ ID NO: 163 - DNA, 19 bp, Artificial Sequence
  Description of Artificial Sequence: Chemically synthesized oligonucleotide
cacagcccggggtctggag

SEQ ID NO: 164 - DNA, 19 bp, Artificial Sequence
  Description of Artificial Sequence: Chemically synthesized oligonucleotide
ctccagaccccgggctgtg

SEQ ID NO: 165 - DNA, 19 bp, Artificial Sequence
  Description of Artificial Sequence: Chemically synthesized oligonucleotide
acagcccggggtctggagc

SEQ ID NO: 166 - DNA, 19 bp, Artificial Sequence
  Description of Artificial Sequence: Chemically synthesized oligonucleotide
gctccagaccccgggctgt

SEQ ID NO: 167 - DNA, 19 bp, Artificial Sequence
  Description of Artificial Sequence: Chemically synthesized oligonucleotide
cagcccggggtctggagcc

SEQ ID NO: 168 - DNA, 19 bp, Artificial Sequence
  Description of Artificial Sequence: Chemically synthesized oligonucleotide
ggctccagaccccgggctg

SEQ ID NO: 169 - DNA, 19 bp, Artificial Sequence
  Description of Artificial Sequence: Chemically synthesized oligonucleotide
agcccggggtctggagccg

SEQ ID NO: 170 - DNA, 19 bp, Artificial Sequence
  Description of Artificial Sequence: Chemically synthesized oligonucleotide
cggctccagaccccgggct

SEQ ID NO: 171 - DNA, 19 bp, Artificial Sequence
  Description of Artificial Sequence: Chemically synthesized oligonucleotide
gcccggggtctggagccgg

SEQ ID NO: 172 - DNA, 19 bp, Artificial Sequence
  Description of Artificial Sequence: Chemically synthesized oligonucleotide
ccggctccagaccccgggc

SEQ ID NO: 173 - DNA, 19 bp, Artificial Sequence
  Description of Artificial Sequence: Chemically synthesized oligonucleotide
cccggggtctggagccggt

SEQ ID NO: 174 - DNA, 19 bp, Artificial Sequence
  Description of Artificial Sequence: Chemically synthesized oligonucleotide
accggctccagaccccggg

SEQ ID NO: 175 - DNA, 19 bp, Artificial Sequence
  Description of Artificial Sequence: Chemically synthesized oligonucleotide
ccggggtctggagccggtg

SEQ ID NO: 176 - DNA, 19 bp, Artificial Sequence
  Description of Artificial Sequence: Chemically synthesized oligonucleotide
caccggctccagaccccgg

SEQ ID NO: 177 - DNA, 19 bp, Artificial Sequence
  Description of Artificial Sequence: Chemically synthesized oligonucleotide
cggggtctggagccggtgt

SEQ ID NO: 178 - DNA, 19 bp, Artificial Sequence
  Description of Artificial Sequence: Chemically synthesized oligonucleotide
acaccggctccagaccccg

SEQ ID NO: 179 - DNA, 19 bp, Artificial Sequence
  Description of Artificial Sequence: Chemically synthesized oligonucleotide
ggggtctggagccggtgtc

SEQ ID NO: 180 - DNA, 19 bp, Artificial Sequence
  Description of Artificial Sequence: Chemically synthesized oligonucleotide
gacaccggctccagacccc

SEQ ID NO: 181 - DNA, 19 bp, Artificial Sequence
  Description of Artificial Sequence: Chemically synthesized oligonucleotide
gggtctggagccggtgtcg

SEQ ID NO: 182 - DNA, 19 bp, Artificial Sequence
  Description of Artificial Sequence: Chemically synthesized oligonucleotide
cgacaccggctccagaccc

SEQ ID NO: 183 - DNA, 19 bp, Artificial Sequence
  Description of Artificial Sequence: Chemically synthesized oligonucleotide
ggtctggagccggtgtcgg

SEQ ID NO: 184 - DNA, 19 bp, Artificial Sequence
  Description of Artificial Sequence: Chemically synthesized oligonucleotide
ccgacaccggctccagacc

SEQ ID NO: 185 - DNA, 19 bp, Artificial Sequence
  Description of Artificial Sequence: Chemically synthesized oligonucleotide
gtctggagccggtgtcgga

SEQ ID NO: 186 - DNA, 19 bp, Artificial Sequence
  Description of Artificial Sequence: Chemically synthesized oligonucleotide
tccgacaccggctccagac

SEQ ID NO: 187 - DNA, 19 bp, Artificial Sequence
  Description of Artificial Sequence: Chemically synthesized oligonucleotide
tctggagccggtgtcggag

SEQ ID NO: 188 - DNA, 19 bp, Artificial Sequence
  Description of Artificial Sequence: Chemically synthesized oligonucleotide
ctccgacaccggctccaga

SEQ ID NO: 189 - DNA, 19 bp, Artificial Sequence
  Description of Artificial Sequence: Chemically synthesized oligonucleotide
ctggagccggtgtcggagc

SEQ ID NO: 190 - DNA, 19 bp, Artificial Sequence
  Description of Artificial Sequence: Chemically synthesized oligonucleotide
gctccgacaccggctccag

SEQ ID NO: 191 - DNA, 19 bp, Artificial Sequence
  Description of Artificial Sequence: Chemically synthesized oligonucleotide
tggagccggtgtcggagct

SEQ ID NO: 192 - DNA, 19 bp, Artificial Sequence
  Description of Artificial Sequence: Chemically synthesized oligonucleotide
agctccgacaccggctcca

SEQ ID NO: 193 - DNA, 19 bp, Artificial Sequence
  Description of Artificial Sequence: Chemically synthesized oligonucleotide
ggagccggtgtcggagctc

SEQ ID NO: 194 - DNA, 19 bp, Artificial Sequence
  Description of Artificial Sequence: Chemically synthesized oligonucleotide
gagctccgacaccggctcc

SEQ ID NO: 195 - DNA, 19 bp, Artificial Sequence
  Description of Artificial Sequence: Chemically synthesized oligonucleotide
gagccggtgtcggagctca

SEQ ID NO: 196 - DNA, 19 bp, Artificial Sequence
  Description of Artificial Sequence: Chemically synthesized oligonucleotide
tgagctccgacaccggctc

SEQ ID NO: 197 - DNA, 19 bp, Artificial Sequence
  Description of Artificial Sequence: Chemically synthesized oligonucleotide
agccggtgtcggagctcat

SEQ ID NO: 198 - DNA, 19 bp, Artificial Sequence
  Description of Artificial Sequence: Chemically synthesized oligonucleotide
atgagctccgacaccggct

SEQ ID NO: 199 - DNA, 19 bp, Artificial Sequence
  Description of Artificial Sequence: Chemically synthesized oligonucleotide
gccggtgtcggagctcatc

SEQ ID NO: 200 - DNA, 19 bp, Artificial Sequence
  Description of Artificial Sequence: Chemically synthesized oligonucleotide
gatgagctccgacaccggc

SEQ ID NO: 201 - DNA, 19 bp, Artificial Sequence
  Description of Artificial Sequence: Chemically synthesized oligonucleotide
ccggtgtcggagctcatct

SEQ ID NO: 202 - DNA, 19 bp, Artificial Sequence
  Description of Artificial Sequence: Chemically synthesized oligonucleotide
agatgagctccgacaccgg

SEQ ID NO: 203 - DNA, 19 bp, Artificial Sequence
  Description of Artificial Sequence: Chemically synthesized oligonucleotide
cggtgtcggagctcatctg

SEQ ID NO: 204 - DNA, 19 bp, Artificial Sequence
  Description of Artificial Sequence: Chemically synthesized oligonucleotide
cagatgagctccgacaccg

SEQ ID NO: 205 - DNA, 19 bp, Artificial Sequence
  Description of Artificial Sequence: Chemically synthesized oligonucleotide
ggtgtcggagctcatctgg

SEQ ID NO: 206 - DNA, 19 bp, Artificial Sequence
  Description of Artificial Sequence: Chemically synthesized oligonucleotide
ccagatgagctccgacacc

SEQ ID NO: 207 - DNA, 19 bp, Artificial Sequence
  Description of Artificial Sequence: Chemically synthesized oligonucleotide
gtgtcggagctcatctggg

SEQ ID NO: 208 - DNA, 19 bp, Artificial Sequence
  Description of Artificial Sequence: Chemically synthesized oligonucleotide
cccagatgagctccgacac

SEQ ID NO: 209 - DNA, 19 bp, Artificial Sequence
  Description of Artificial Sequence: Chemically synthesized oligonucleotide
tgtcggagctcatctgggc

SEQ ID NO: 210 - DNA, 19 bp, Artificial Sequence
  Description of Artificial Sequence: Chemically synthesized oligonucleotide
gcccagatgagctccgaca

SEQ ID NO: 211 - DNA, 19 bp, Artificial Sequence
  Description of Artificial Sequence: Chemically synthesized oligonucleotide
gtcggagctcatctgggcc

SEQ ID NO: 212 - DNA, 19 bp, Artificial Sequence
  Description of Artificial Sequence: Chemically synthesized oligonucleotide
ggcccagatgagctccgac

SEQ ID NO: 213 - DNA, 19 bp, Artificial Sequence
  Description of Artificial Sequence: Chemically synthesized oligonucleotide
tcggagctcatctgggccc

SEQ ID NO: 214 - DNA, 19 bp, Artificial Sequence
  Description of Artificial Sequence: Chemically synthesized oligonucleotide
gggcccagatgagctccga

SEQ ID NO: 215 - DNA, 19 bp, Artificial Sequence
  Description of Artificial Sequence: Chemically synthesized oligonucleotide
cggagctcatctgggccca

SEQ ID NO: 216 - DNA, 19 bp, Artificial Sequence
  Description of Artificial Sequence: Chemically synthesized oligonucleotide
tgggcccagatgagctccg

SEQ ID NO: 217 - DNA, 19 bp, Artificial Sequence
  Description of Artificial Sequence: Chemically synthesized oligonucleotide
ggagctcatctgggcccat

SEQ ID NO: 218 - DNA, 19 bp, Artificial Sequence
  Description of Artificial Sequence: Chemically synthesized oligonucleotide
atgggcccagatgagctcc

SEQ ID NO: 219 - DNA, 19 bp, Artificial Sequence
  Description of Artificial Sequence: Chemically synthesized oligonucleotide
gagctcatctgggcccatg

SEQ ID NO: 220 - DNA, 19 bp, Artificial Sequence
  Description of Artificial Sequence: Chemically synthesized oligonucleotide
catgggcccagatgagctc

SEQ ID NO: 221 - DNA, 19 bp, Artificial Sequence
  Description of Artificial Sequence: Chemically synthesized oligonucleotide
agctcatctgggcccatga

SEQ ID NO: 222 - DNA, 19 bp, Artificial Sequence
  Description of Artificial Sequence: Chemically synthesized oligonucleotide
tcatgggcccagatgagct

SEQ ID NO: 223 - DNA, 19 bp, Artificial Sequence
  Description of Artificial Sequence: Chemically synthesized oligonucleotide
gctcatctgggcccatgac

SEQ ID NO: 224 - DNA, 19 bp, Artificial Sequence
  Description of Artificial Sequence: Chemically synthesized oligonucleotide
gtcatgggcccagatgagc

SEQ ID NO: 225 - DNA, 19 bp, Artificial Sequence
  Description of Artificial Sequence: Chemically synthesized oligonucleotide
ctcatctgggcccatgacc

SEQ ID NO: 226 - DNA, 19 bp, Artificial Sequence
  Description of Artificial Sequence: Chemically synthesized oligonucleotide
ggtcatgggcccagatgag

SEQ ID NO: 227 - DNA, 19 bp, Artificial Sequence
  Description of Artificial Sequence: Chemically synthesized oligonucleotide
tcatctgggcccatgacct

SEQ ID NO: 228 - DNA, 19 bp, Artificial Sequence
  Description of Artificial Sequence: Chemically synthesized oligonucleotide
aggtcatgggcccagatga

SEQ ID NO: 229 - DNA, 19 bp, Artificial Sequence
  Description of Artificial Sequence: Chemically synthesized oligonucleotide
catctgggcccatgacctc

SEQ ID NO: 230 - DNA, 19 bp, Artificial Sequence
  Description of Artificial Sequence: Chemically synthesized oligonucleotide
gaggtcatgggcccagatg

SEQ ID NO: 231 - DNA, 19 bp, Artificial Sequence
  Description of Artificial Sequence: Chemically synthesized oligonucleotide
atctgggcccatgacctct

SEQ ID NO: 232 - DNA, 19 bp, Artificial Sequence
  Description of Artificial Sequence: Chemically synthesized oligonucleotide
agaggtcatgggcccagat

SEQ ID NO: 233 - DNA, 19 bp, Artificial Sequence
  Description of Artificial Sequence: Chemically synthesized oligonucleotide
tctgggcccatgacctctc

SEQ ID NO: 234 - DNA, 19 bp, Artificial Sequence
  Description of Artificial Sequence: Chemically synthesized oligonucleotide
gagaggtcatgggcccaga

SEQ ID NO: 235 - DNA, 19 bp, Artificial Sequence
  Description of Artificial Sequence: Chemically synthesized oligonucleotide
ctgggcccatgacctctcc

SEQ ID NO: 236 - DNA, 19 bp, Artificial Sequence
  Description of Artificial Sequence: Chemically synthesized oligonucleotide
ggagaggtcatgggcccag

SEQ ID NO: 237 - DNA, 19 bp, Artificial Sequence
  Description of Artificial Sequence: Chemically synthesized oligonucleotide
tgggcccatgacctctcca

SEQ ID NO: 238 - DNA, 19 bp, Artificial Sequence
  Description of Artificial Sequence: Chemically synthesized oligonucleotide
tggagaggtcatgggccca

SEQ ID NO: 239 - DNA, 19 bp, Artificial Sequence
  Description of Artificial Sequence: Chemically synthesized oligonucleotide
gggcccatgacctctccag

SEQ ID NO: 240 - DNA, 19 bp, Artificial Sequence
  Description of Artificial Sequence: Chemically synthesized oligonucleotide
ctggagaggtcatgggccc

SEQ ID NO: 241 - DNA, 19 bp, Artificial Sequence
  Description of Artificial Sequence: Chemically synthesized oligonucleotide
ggcccatgacctctccaga

SEQ ID NO: 242 - DNA, 19 bp, Artificial Sequence
  Description of Artificial Sequence: Chemically synthesized oligonucleotide
tctggagaggtcatgggcc

SEQ ID NO: 243 - DNA, 19 bp, Artificial Sequence
  Description of Artificial Sequence: Chemically synthesized oligonucleotide
gcccatgacctctccagac

SEQ ID NO: 244 - DNA, 19 bp, Artificial Sequence
  Description of Artificial Sequence: Chemically synthesized oligonucleotide
gtctggagaggtcatgggc

SEQ ID NO: 245 - DNA, 19 bp, Artificial Sequence
  Description of Artificial Sequence: Chemically synthesized oligonucleotide
cccatgacctctccagaca

SEQ ID NO: 246 - DNA, 19 bp, Artificial Sequence
  Description of Artificial Sequence: Chemically synthesized oligonucleotide
tgtctggagaggtcatggg

SEQ ID NO: 247 - DNA, 19 bp, Artificial Sequence
  Description of Artificial Sequence: Chemically synthesized oligonucleotide
ccatgacctctccagacat

SEQ ID NO: 248 - DNA, 19 bp, Artificial Sequence
  Description of Artificial Sequence: Chemically synthesized oligonucleotide
atgtctggagaggtcatgg

SEQ ID NO: 249 - DNA, 19 bp, Artificial Sequence
  Description of Artificial Sequence: Chemically synthesized oligonucleotide
catgacctctccagacatt

SEQ ID NO: 250 - DNA, 19 bp, Artificial Sequence
  Description of Artificial Sequence: Chemically synthesized oligonucleotide
aatgtctggagaggtcatg

SEQ ID NO: 251 - DNA, 19 bp, Artificial Sequence
  Description of Artificial Sequence: Chemically synthesized oligonucleotide
atgacctctccagacattt

SEQ ID NO: 252 - DNA, 19 bp, Artificial Sequence
  Description of Artificial Sequence: Chemically synthesized oligonucleotide
aaatgtctggagaggtcat

SEQ ID NO: 253 - DNA, 19 bp, Artificial Sequence
  Description of Artificial Sequence: Chemically synthesized oligonucleotide
tgacctctccagacatttg

SEQ ID NO: 254 - DNA, 19 bp, Artificial Sequence
  Description of Artificial Sequence: Chemically synthesized oligonucleotide
caaatgtctggagaggtca

SEQ ID NO: 255 - DNA, 19 bp, Artificial Sequence
  Description of Artificial Sequence: Chemically synthesized oligonucleotide
gacctctccagacatttgg

SEQ ID NO: 256 - DNA, 19 bp, Artificial Sequence
  Description of Artificial Sequence: Chemically synthesized oligonucleotide
ccaaatgtctggagaggtc

SEQ ID NO: 257 - DNA, 19 bp, Artificial Sequence
  Description of Artificial Sequence: Chemically synthesized oligonucleotide
acctctccagacatttggc

SEQ ID NO: 258 - DNA, 19 bp, Artificial Sequence
  Description of Artificial Sequence: Chemically synthesized oligonucleotide
gccaaatgtctggagaggt

SEQ ID NO: 259 - DNA, 19 bp, Artificial Sequence
  Description of Artificial Sequence: Chemically synthesized oligonucleotide
cctctccagacatttggca

SEQ ID NO: 260 - DNA, 19 bp, Artificial Sequence
  Description of Artificial Sequence: Chemically synthesized oligonucleotide
tgccaaatgtctggagagg

SEQ ID NO: 261 - DNA, 19 bp, Artificial Sequence
  Description of Artificial Sequence: Chemically synthesized oligonucleotide
ctctccagacatttggcaa

SEQ ID NO: 262 - DNA, 19 bp, Artificial Sequence
  Description of Artificial Sequence: Chemically synthesized oligonucleotide
ttgccaaatgtctggagag

SEQ ID NO: 263 - DNA, 19 bp, Artificial Sequence
  Description of Artificial Sequence: Chemically synthesized oligonucleotide
tctccagacatttggcaaa

SEQ ID NO: 264 - DNA, 19 bp, Artificial Sequence
  Description of Artificial Sequence: Chemically synthesized oligonucleotide
tttgccaaatgtctggaga

SEQ ID NO: 265 - DNA, 19 bp, Artificial Sequence
  Description of Artificial Sequence: Chemically synthesized oligonucleotide
ctccagacatttggcaaaa

SEQ ID NO: 266 - DNA, 19 bp, Artificial Sequence
  Description of Artificial Sequence: Chemically synthesized oligonucleotide
ttttgccaaatgtctggag

SEQ ID NO: 267 - DNA, 19 bp, Artificial Sequence
  Description of Artificial Sequence: Chemically synthesized oligonucleotide
tccagacatttggcaaaat

SEQ ID NO: 268 - DNA, 19 bp, Artificial Sequence
  Description of Artificial Sequence: Chemically synthesized oligonucleotide
attttgccaaatgtctgga

SEQ ID NO: 269 - DNA, 19 bp, Artificial Sequence
  Description of Artificial Sequence: Chemically synthesized oligonucleotide
ccagacatttggcaaaatc

SEQ ID NO: 270 - DNA, 19 bp, Artificial Sequence
  Description of Artificial Sequence: Chemically synthesized oligonucleotide
gattttgccaaatgtctgg

SEQ ID NO: 271 - DNA, 19 bp, Artificial Sequence
  Description of Artificial Sequence: Chemically synthesized oligonucleotide
cagacatttggcaaaatca

SEQ ID NO: 272 - DNA, 19 bp, Artificial Sequence
  Description of Artificial Sequence: Chemically synthesized oligonucleotide
tgattttgccaaatgtctg

SEQ ID NO: 273 - DNA, 19 bp, Artificial Sequence
  Description of Artificial Sequence: Chemically synthesized oligonucleotide
agacatttggcaaaatcaa

SEQ ID NO: 274 - DNA, 19 bp, Artificial Sequence
  Description of Artificial Sequence: Chemically synthesized oligonucleotide
ttgattttgccaaatgtct

SEQ ID NO: 275 - DNA, 19 bp, Artificial Sequence
  Description of Artificial Sequence: Chemically synthesized oligonucleotide
gacatttggcaaaatcaag

SEQ ID NO: 276 - DNA, 19 bp, Artificial Sequence
  Description of Artificial Sequence: Chemically synthesized oligonucleotide
cttgattttgccaaatgtc

SEQ ID NO: 277 - DNA, 19 bp, Artificial Sequence
  Description of Artificial Sequence: Chemically synthesized oligonucleotide
acatttggcaaaatcaagg

SEQ ID NO: 278 - DNA, 19 bp, Artificial Sequence
  Description of Artificial Sequence: Chemically synthesized oligonucleotide
ccttgattttgccaaatgt

SEQ ID NO: 279 - DNA, 19 bp, Artificial Sequence
  Description of Artificial Sequence: Chemically synthesized oligonucleotide
catttggcaaaatcaaggc

SEQ ID NO: 280 - DNA, 19 bp, Artificial Sequence
  Description of Artificial Sequence: Chemically synthesized oligonucleotide
gccttgattttgccaaatg

SEQ ID NO: 281 - DNA, 19 bp, Artificial Sequence
  Description of Artificial Sequence: Chemically synthesized oligonucleotide
atttggcaaaatcaaggcc

SEQ ID NO: 282 - DNA, 19 bp, Artificial Sequence
  Description of Artificial Sequence: Chemically synthesized oligonucleotide
ggccttgattttgccaaat

SEQ ID NO: 283 - DNA, 19 bp, Artificial Sequence
  Description of Artificial Sequence: Chemically synthesized oligonucleotide
tttggcaaaatcaaggccc

SEQ ID NO: 284 - DNA, 19 bp, Artificial Sequence
  Description of Artificial Sequence: Chemically synthesized oligonucleotide
gggccttgattttgccaaa

SEQ ID NO: 285 - DNA, 19 bp, Artificial Sequence
  Description of Artificial Sequence: Chemically synthesized oligonucleotide
ttggcaaaatcaaggccct

SEQ ID NO: 286 - DNA, 19 bp, Artificial Sequence
  Description of Artificial Sequence: Chemically synthesized oligonucleotide
agggccttgattttgccaa

SEQ ID NO: 287 - DNA, 19 bp, Artificial Sequence
  Description of Artificial Sequence: Chemically synthesized oligonucleotide
tggcaaaatcaaggccctt

SEQ ID NO: 288 - DNA, 19 bp, Artificial Sequence
  Description of Artificial Sequence: Chemically synthesized oligonucleotide
aagggccttgattttgcca

SEQ ID NO: 289 - DNA, 19 bp, Artificial Sequence
  Description of Artificial Sequence: Chemically synthesized oligonucleotide
ggcaaaatcaaggccctta

SEQ ID NO: 290 - DNA, 19 bp, Artificial Sequence
  Description of Artificial Sequence: Chemically synthesized oligonucleotide
taagggccttgattttgcc

SEQ ID NO: 291 - DNA, 19 bp, Artificial Sequence
  Description of Artificial Sequence: Chemically synthesized oligonucleotide
gcaaaatcaaggcccttag

SEQ ID NO: 292 - DNA, 19 bp, Artificial Sequence
  Description of Artificial Sequence: Chemically synthesized oligonucleotide
ctaagggccttgattttgc

SEQ ID NO: 293 - DNA, 19 bp, Artificial Sequence
  Description of Artificial Sequence: Chemically synthesized oligonucleotide
caaaatcaaggcccttaga

SEQ ID NO: 294 - DNA, 19 bp, Artificial Sequence
  Description of Artificial Sequence: Chemically synthesized oligonucleotide
tctaagggccttgattttg

SEQ ID NO: 295 - DNA, 19 bp, Artificial Sequence
  Description of Artificial Sequence: Chemically synthesized oligonucleotide
aaaatcaaggcccttagac

SEQ ID NO: 296 - DNA, 19 bp, Artificial Sequence
  Description of Artificial Sequence: Chemically synthesized oligonucleotide
gtctaagggccttgatttt

SEQ ID NO: 297 - DNA, 19 bp, Artificial Sequence
  Description of Artificial Sequence: Chemically synthesized oligonucleotide
aaatcaaggcccttagacc

SEQ ID NO: 298 - DNA, 19 bp, Artificial Sequence
  Description of Artificial Sequence: Chemically synthesized oligonucleotide
ggtctaagggccttgattt

SEQ ID NO: 299 - DNA, 19 bp, Artificial Sequence
  Description of Artificial Sequence: Chemically synthesized oligonucleotide
aatcaaggcccttagacca

SEQ ID NO: 300 - DNA, 19 bp, Artificial Sequence
  Description of Artificial Sequence: Chemically synthesized oligonucleotide
tggtctaagggccttgatt

SEQ ID NO: 301 - DNA, 19 bp, Artificial Sequence
  Description of Artificial Sequence: Chemically synthesized oligonucleotide
atcaaggcccttagaccag

SEQ ID NO: 302 - DNA, 19 bp, Artificial Sequence
  Description of Artificial Sequence: Chemically synthesized oligonucleotide
ctggtctaagggccttgat

SEQ ID NO: 303 - DNA, 19 bp, Artificial Sequence
  Description of Artificial Sequence: Chemically synthesized oligonucleotide
tcaaggcccttagaccagg

SEQ ID NO: 304 - DNA, 19 bp, Artificial Sequence
  Description of Artificial Sequence: Chemically synthesized oligonucleotide
cctggtctaagggccttga

SEQ ID NO: 305 - DNA, 19 bp, Artificial Sequence
  Description of Artificial Sequence: Chemically synthesized oligonucleotide
caaggcccttagaccaggg

SEQ ID NO: 306 - DNA, 19 bp, Artificial Sequence
  Description of Artificial Sequence: Chemically synthesized oligonucleotide
ccctggtctaagggccttg

SEQ ID NO: 307 - DNA, 19 bp, Artificial Sequence
  Description of Artificial Sequence: Chemically synthesized oligonucleotide
aaggcccttagaccaggga

SEQ ID NO: 308 - DNA, 19 bp, Artificial Sequence
  Description of Artificial Sequence: Chemically synthesized oligonucleotide
tccctggtctaagggcctt

SEQ ID NO: 309 - DNA, 19 bp, Artificial Sequence
  Description of Artificial Sequence: Chemically synthesized oligonucleotide
aggcccttagaccagggac

SEQ ID NO: 310 - DNA, 19 bp, Artificial Sequence
  Description of Artificial Sequence: Chemically synthesized oligonucleotide
gtccctggtctaagggcct

SEQ ID NO: 311 - DNA, 19 bp, Artificial Sequence
  Description of Artificial Sequence: Chemically synthesized oligonucleotide
ggcccttagaccagggaca

SEQ ID NO: 312 - DNA, 19 bp, Artificial Sequence
  Description of Artificial Sequence: Chemically synthesized oligonucleotide
tgtccctggtctaagggcc

SEQ ID NO: 313 - DNA, 19 bp, Artificial Sequence
  Description of Artificial Sequence: Chemically synthesized oligonucleotide
gcccttagaccagggacag

SEQ ID NO: 314 - DNA, 19 bp, Artificial Sequence
  Description of Artificial Sequence: Chemically synthesized oligonucleotide
ctgtccctggtctaagggc

SEQ ID NO: 315 - DNA, 19 bp, Artificial Sequence
  Description of Artificial Sequence: Chemically synthesized oligonucleotide
cccttagaccagggacaga

SEQ ID NO: 316 - DNA, 19 bp, Artificial Sequence
  Description of Artificial Sequence: Chemically synthesized oligonucleotide
tctgtccctggtctaaggg

SEQ ID NO: 317 - DNA, 19 bp, Artificial Sequence
  Description of Artificial Sequence: Chemically synthesized oligonucleotide
ccttagaccagggacagac

SEQ ID NO: 318 - DNA, 19 bp, Artificial Sequence
  Description of Artificial Sequence: Chemically synthesized oligonucleotide
gtctgtccctggtctaagg

SEQ ID NO: 319 - DNA, 19 bp, Artificial Sequence
  Description of Artificial Sequence: Chemically synthesized oligonucleotide
cttagaccagggacagacc

SEQ ID NO: 320 - DNA, 19 bp, Artificial Sequence
  Description of Artificial Sequence: Chemically synthesized oligonucleotide
ggtctgtccctggtctaag

SEQ ID NO: 321 - DNA, 19 bp, Artificial Sequence
  Description of Artificial Sequence: Chemically synthesized oligonucleotide
ttagaccagggacagaccc

SEQ ID NO: 322 - DNA, 19 bp, Artificial Sequence
  Description of Artificial Sequence: Chemically synthesized oligonucleotide
gggtctgtccctggtctaa

SEQ ID NO: 323 - DNA, 19 bp, Artificial Sequence
  Description of Artificial Sequence: Chemically synthesized oligonucleotide
tagaccagggacagaccca

SEQ ID NO: 324 - DNA, 19 bp, Artificial Sequence
  Description of Artificial Sequence: Chemically synthesized oligonucleotide
tgggtctgtccctggtcta

SEQ ID NO: 325 - DNA, 19 bp, Artificial Sequence
  Description of Artificial Sequence: Chemically synthesized oligonucleotide
agaccagggacagacccaa

SEQ ID NO: 326 - DNA, 19 bp, Artificial Sequence
  Description of Artificial Sequence: Chemically synthesized oligonucleotide
ttgggtctgtccctggtct

SEQ ID NO: 327 - DNA, 19 bp, Artificial Sequence
  Description of Artificial Sequence: Chemically synthesized oligonucleotide
gaccagggacagacccaag

SEQ ID NO: 328 - DNA, 19 bp, Artificial Sequence
  Description of Artificial Sequence: Chemically synthesized oligonucleotide
cttgggtctgtccctggtc

SEQ ID NO: 329 - DNA, 19 bp, Artificial Sequence
  Description of Artificial Sequence: Chemically synthesized oligonucleotide
accagggacagacccaagc

SEQ ID NO: 330 - DNA, 19 bp, Artificial Sequence
  Description of Artificial Sequence: Chemically synthesized oligonucleotide
gcttgggtctgtccctggt

SEQ ID NO: 331 - DNA, 19 bp, Artificial Sequence
  Description of Artificial Sequence: Chemically synthesized oligonucleotide
ccagggacagacccaagcc

SEQ ID NO: 332 - DNA, 19 bp, Artificial Sequence
  Description of Artificial Sequence: Chemically synthesized oligonucleotide
ggcttgggtctgtccctgg

SEQ ID NO: 333 - DNA, 19 bp, Artificial Sequence
  Description of Artificial Sequence: Chemically synthesized oligonucleotide
cagggacagacccaagccc

SEQ ID NO: 334 - DNA, 19 bp, Artificial Sequence
  Description of Artificial Sequence: Chemically synthesized oligonucleotide
gggcttgggtctgtccctg

SEQ ID NO: 335 - DNA, 19 bp, Artificial Sequence
  Description of Artificial Sequence: Chemically synthesized oligonucleotide
agggacagacccaagccca

SEQ ID NO: 336 - DNA, 19 bp, Artificial Sequence
  Description of Artificial Sequence: Chemically synthesized oligonucleotide
tgggcttgggtctgtccct

SEQ ID NO: 337 - DNA, 19 bp, Artificial Sequence
  Description of Artificial Sequence: Chemically synthesized oligonucleotide
gggacagacccaagcccag

SEQ ID NO: 338 - DNA, 19 bp, Artificial Sequence
  Description of Artificial Sequence: Chemically synthesized oligonucleotide
ctgggcttgggtctgtccc

SEQ ID NO: 339 - DNA, 19 bp, Artificial Sequence
  Description of Artificial Sequence: Chemically synthesized oligonucleotide
ggacagacccaagcccagg

SEQ ID NO: 340 - DNA, 19 bp, Artificial Sequence
  Description of Artificial Sequence: Chemically synthesized oligonucleotide
cctgggcttgggtctgtcc

SEQ ID NO: 341 - DNA, 19 bp, Artificial Sequence
  Description of Artificial Sequence: Chemically synthesized oligonucleotide
gacagacccaagcccaggc

SEQ ID NO: 342 - DNA, 19 bp, Artificial Sequence
  Description of Artificial Sequence: Chemically synthesized oligonucleotide
gcctgggcttgggtctgtc

SEQ ID NO: 343 - DNA, 19 bp, Artificial Sequence
  Description of Artificial Sequence: Chemically synthesized oligonucleotide
acagacccaagcccaggcc

SEQ ID NO: 344 - DNA, 19 bp, Artificial Sequence
  Description of Artificial Sequence: Chemically synthesized oligonucleotide
ggcctgggcttgggtctgt

SEQ ID NO: 345 - DNA, 19 bp, Artificial Sequence
  Description of Artificial Sequence: Chemically synthesized oligonucleotide
cagacccaagcccaggccc

SEQ ID NO: 346 - DNA, 19 bp, Artificial Sequence
  Description of Artificial Sequence: Chemically synthesized oligonucleotide
gggcctgggcttgggtctg

SEQ ID NO: 347 - DNA, 19 bp, Artificial Sequence
  Description of Artificial Sequence: Chemically synthesized oligonucleotide
agacccaagcccaggccct

SEQ ID NO: 348 - DNA, 19 bp, Artificial Sequence
  Description of Artificial Sequence: Chemically synthesized oligonucleotide
agggcctgggcttgggtct

SEQ ID NO: 349 - DNA, 19 bp, Artificial Sequence
  Description of Artificial Sequence: Chemically synthesized oligonucleotide
gacccaagcccaggccctc

SEQ ID NO: 350 - DNA, 19 bp, Artificial Sequence
  Description of Artificial Sequence: Chemically synthesized oligonucleotide
gagggcctgggcttgggtc

SEQ ID NO: 351 - DNA, 19 bp, Artificial Sequence
  Description of Artificial Sequence: Chemically synthesized oligonucleotide
acccaagcccaggccctcc

SEQ ID NO: 352 - DNA, 19 bp, Artificial Sequence
  Description of Artificial Sequence: Chemically synthesized oligonucleotide
ggagggcctgggcttgggt

SEQ ID NO: 353 - DNA, 19 bp, Artificial Sequence
  Description of Artificial Sequence: Chemically synthesized oligonucleotide
cccaagcccaggccctccc

SEQ ID NO: 354 - DNA, 19 bp, Artificial Sequence
  Description of Artificial Sequence: Chemically synthesized oligonucleotide
gggagggcctgggcttggg

SEQ ID NO: 355 - DNA, 19 bp, Artificial Sequence
  Description of Artificial Sequence: Chemically synthesized oligonucleotide
ccaagcccaggccctccca

SEQ ID NO: 356 - DNA, 19 bp, Artificial Sequence
  Description of Artificial Sequence: Chemically synthesized oligonucleotide
tgggagggcctgggcttgg

SEQ ID NO: 357 - DNA, 19 bp, Artificial Sequence
  Description of Artificial Sequence: Chemically synthesized oligonucleotide
caagcccaggccctcccag

SEQ ID NO: 358 - DNA, 19 bp, Artificial Sequence
  Description of Artificial Sequence: Chemically synthesized oligonucleotide
ctgggagggcctgggcttg

SEQ ID NO: 359 - DNA, 19 bp, Artificial Sequence
  Description of Artificial Sequence: Chemically synthesized oligonucleotide
aagcccaggccctcccaga

SEQ ID NO: 360 - DNA, 19 bp, Artificial Sequence
  Description of Artificial Sequence: Chemically synthesized oligonucleotide
tctgggagggcctgggctt

SEQ ID NO: 361 - DNA, 19 bp, Artificial Sequence
  Description of Artificial Sequence: Chemically synthesized oligonucleotide
agcccaggccctcccagag

SEQ ID NO: 362 - DNA, 19 bp, Artificial Sequence
  Description of Artificial Sequence: Chemically synthesized oligonucleotide
ctctgggagggcctgggct

SEQ ID NO: 363 - DNA, 19 bp, Artificial Sequence
  Description of Artificial Sequence: Chemically synthesized oligonucleotide
gcccaggccctcccagagg

SEQ ID NO: 364 - DNA, 19 bp, Artificial Sequence
  Description of Artificial Sequence: Chemically synthesized oligonucleotide
cctctgggagggcctgggc

SEQ ID NO: 365 - DNA, 19 bp, Artificial Sequence
  Description of Artificial Sequence: Chemically synthesized oligonucleotide
cccaggccctcccagaggt

SEQ ID NO: 366 - DNA, 19 bp, Artificial Sequence
  Description of Artificial Sequence: Chemically synthesized oligonucleotide
acctctgggagggcctggg

SEQ ID NO: 367 - DNA, 19 bp, Artificial Sequence
  Description of Artificial Sequence: Chemically synthesized oligonucleotide
ccaggccctcccagaggtc

SEQ ID NO: 368 - DNA, 19 bp, Artificial Sequence
  Description of Artificial Sequence: Chemically synthesized oligonucleotide
gacctctgggagggcctgg

SEQ ID NO: 369 - DNA, 19 bp, Artificial Sequence
  Description of Artificial Sequence: Chemically synthesized oligonucleotide
caggccctcccagaggtcc

SEQ ID NO: 370 - DNA, 19 bp, Artificial Sequence
  Description of Artificial Sequence: Chemically synthesized oligonucleotide
ggacctctgggagggcctg

SEQ ID NO: 371 - DNA, 19 bp, Artificial Sequence
  Description of Artificial Sequence: Chemically synthesized oligonucleotide
aggccctcccagaggtcct

SEQ ID NO: 372 - DNA, 19 bp, Artificial Sequence
  Description of Artificial Sequence: Chemically synthesized oligonucleotide
aggacctctgggagggcct

SEQ ID NO: 373 - DNA, 19 bp, Artificial Sequence
  Description of Artificial Sequence: Chemically synthesized oligonucleotide
ggccctcccagaggtccta

SEQ ID NO: 374 - DNA, 19 bp, Artificial Sequence
  Description of Artificial Sequence: Chemically synthesized oligonucleotide
taggacctctgggagggcc

SEQ ID NO: 375 - DNA, 19 bp, Artificial Sequence
  Description of Artificial Sequence: Chemically synthesized oligonucleotide
gccctcccagaggtcctag

SEQ ID NO: 376 - DNA, 19 bp, Artificial Sequence
  Description of Artificial Sequence: Chemically synthesized oligonucleotide
ctaggacctctgggagggc

SEQ ID NO: 377 - DNA, 19 bp, Artificial Sequence
  Description of Artificial Sequence: Chemically synthesized oligonucleotide
ccctcccagaggtcctagg

SEQ ID NO: 378 - DNA, 19 bp, Artificial Sequence
  Description of Artificial Sequence: Chemically synthesized oligonucleotide
cctaggacctctgggaggg

SEQ ID NO: 379 - DNA, 19 bp, Artificial Sequence
  Description of Artificial Sequence: Chemically synthesized oligonucleotide
cctcccagaggtcctagga

SEQ ID NO: 380 - DNA, 19 bp, Artificial Sequence
  Description of Artificial Sequence: Chemically synthesized oligonucleotide
tcctaggacctctgggagg

SEQ ID NO: 381 - DNA, 19 bp, Artificial Sequence
  Description of Artificial Sequence: Chemically synthesized oligonucleotide
ctcccagaggtcctaggac

SEQ ID NO: 382 - DNA, 19 bp, Artificial Sequence
  Description of Artificial Sequence: Chemically synthesized oligonucleotide
gtcctaggacctctgggag

SEQ ID NO: 383 - DNA, 19 bp, Artificial Sequence
  Description of Artificial Sequence: Chemically synthesized oligonucleotide
tcccagaggtcctaggacg

SEQ ID NO: 384 - DNA, 19 bp, Artificial Sequence
  Description of Artificial Sequence: Chemically synthesized oligonucleotide
cgtcctaggacctctggga

SEQ ID NO: 385 - DNA, 19 bp, Artificial Sequence
  Description of Artificial Sequence: Chemically synthesized oligonucleotide
cccagaggtcctaggacgc

SEQ ID NO: 386 - DNA, 19 bp, Artificial Sequence
  Description of Artificial Sequence: Chemically synthesized oligonucleotide
gcgtcctaggacctctggg

SEQ ID NO: 387 - DNA, 19 bp, Artificial Sequence
  Description of Artificial Sequence: Chemically synthesized oligonucleotide
ccagaggtcctaggacgca

SEQ ID NO: 388 - DNA, 19 bp, Artificial Sequence
  Description of Artificial Sequence: Chemically synthesized oligonucleotide
tgcgtcctaggacctctgg

SEQ ID NO: 389 - DNA, 19 bp, Artificial Sequence
  Description of Artificial Sequence: Chemically synthesized oligonucleotide
cagaggtcctaggacgcaa

SEQ ID NO: 390 - DNA, 19 bp, Artificial Sequence
  Description of Artificial Sequence: Chemically synthesized oligonucleotide
ttgcgtcctaggacctctg

SEQ ID NO: 391 - DNA, 19 bp, Artificial Sequence
  Description of Artificial Sequence: Chemically synthesized oligonucleotide
agaggtcctaggacgcaac

SEQ ID NO: 392 - DNA, 19 bp, Artificial Sequence
  Description of Artificial Sequence: Chemically synthesized oligonucleotide
gttgcgtcctaggacctct

SEQ ID NO: 393 - DNA, 19 bp, Artificial Sequence
  Description of Artificial Sequence: Chemically synthesized oligonucleotide
gaggtcctaggacgcaacc

SEQ ID NO: 394 - DNA, 19 bp, Artificial Sequence
  Description of Artificial Sequence: Chemically synthesized oligonucleotide
ggttgcgtcctaggacctc

SEQ ID NO: 395 - DNA, 19 bp, Artificial Sequence
  Description of Artificial Sequence: Chemically synthesized oligonucleotide
aggtcctaggacgcaaccc

SEQ ID NO: 396 - DNA, 19 bp, Artificial Sequence
  Description of Artificial Sequence: Chemically synthesized oligonucleotide
gggttgcgtcctaggacct

SEQ ID NO: 397 - DNA, 19 bp, Artificial Sequence
  Description of Artificial Sequence: Chemically synthesized oligonucleotide
ggtcctaggacgcaaccct

SEQ ID NO: 398 - DNA, 19 bp, Artificial Sequence
  Description of Artificial Sequence: Chemically synthesized oligonucleotide
agggttgcgtcctaggacc

SEQ ID NO: 399 - DNA, 19 bp, Artificial Sequence
  Description of Artificial Sequence: Chemically synthesized oligonucleotide
gtcctaggacgcaaccctt

SEQ ID NO: 400 - DNA, 19 bp, Artificial Sequence
  Description of Artificial Sequence: Chemically synthesized oligonucleotide
aagggttgcgtcctaggac

SEQ ID NO: 401 - DNA, 19 bp, Artificial Sequence
  Description of Artificial Sequence: Chemically synthesized oligonucleotide
tcctaggacgcaacccttt

SEQ ID NO: 402 - DNA, 19 bp, Artificial Sequence
  Description of Artificial Sequence: Chemically synthesized oligonucleotide
aaagggttgcgtcctagga

SEQ ID NO: 403 - DNA, 19 bp, Artificial Sequence
  Description of Artificial Sequence: Chemically synthesized oligonucleotide
cctaggacgcaaccctttg

SEQ ID NO: 404 - DNA, 19 bp, Artificial Sequence
  Description of Artificial Sequence: Chemically synthesized oligonucleotide
caaagggttgcgtcctagg

SEQ ID NO: 405 - DNA, 19 bp, Artificial Sequence
  Description of Artificial Sequence: Chemically synthesized oligonucleotide
ctaggacgcaaccctttgt

SEQ ID NO: 406 - DNA, 19 bp, Artificial Sequence
  Description of Artificial Sequence: Chemically synthesized oligonucleotide
acaaagggttgcgtcctag

SEQ ID NO: 407 - DNA, 19 bp, Artificial Sequence
  Description of Artificial Sequence: Chemically synthesized oligonucleotide
taggacgcaaccctttgtg

SEQ ID NO: 408 - DNA, 19 bp, Artificial Sequence
  Description of Artificial Sequence: Chemically synthesized oligonucleotide
cacaaagggttgcgtccta

SEQ ID NO: 409 - DNA, 19 bp, Artificial Sequence
  Description of Artificial Sequence: Chemically synthesized oligonucleotide
aggacgcaaccctttgtgc

SEQ ID NO: 410 - DNA, 19 bp, Artificial Sequence
  Description of Artificial Sequence: Chemically synthesized oligonucleotide
gcacaaagggttgcgtcct

SEQ ID NO: 411 - DNA, 19 bp, Artificial Sequence
  Description of Artificial Sequence: Chemically synthesized oligonucleotide
ggacgcaaccctttgtgcc

SEQ ID NO: 412 - DNA, 19 bp, Artificial Sequence
  Description of Artificial Sequence: Chemically synthesized oligonucleotide
ggcacaaagggttgcgtcc

SEQ ID NO: 413 - DNA, 19 bp, Artificial Sequence
  Description of Artificial Sequence: Chemically synthesized oligonucleotide
gacgcaaccctttgtgccc

SEQ ID NO: 414 - DNA, 19 bp, Artificial Sequence
  Description of Artificial Sequence: Chemically synthesized oligonucleotide
gggcacaaagggttgcgtc

SEQ ID NO: 415 - DNA, 19 bp, Artificial Sequence
  Description of Artificial Sequence: Chemically synthesized oligonucleotide
acgcaaccctttgtgccct

SEQ ID NO: 416 - DNA, 19 bp, Artificial Sequence
  Description of Artificial Sequence: Chemically synthesized oligonucleotide
agggcacaaagggttgcgt

SEQ ID NO: 417 - DNA, 19 bp, Artificial Sequence
  Description of Artificial Sequence: Chemically synthesized oligonucleotide
cgcaaccctttgtgccctt

SEQ ID NO: 418 - DNA, 19 bp, Artificial Sequence
  Description of Artificial Sequence: Chemically synthesized oligonucleotide
aagggcacaaagggttgcg

SEQ ID NO: 419 - DNA, 19 bp, Artificial Sequence
  Description of Artificial Sequence: Chemically synthesized oligonucleotide
gcaaccctttgtgcccttg

SEQ ID NO: 420 - DNA, 19 bp, Artificial Sequence
  Description of Artificial Sequence: Chemically synthesized oligonucleotide
caagggcacaaagggttgc

SEQ ID NO: 421 - DNA, 19 bp, Artificial Sequence
  Description of Artificial Sequence: Chemically synthesized oligonucleotide
caaccctttgtgcccttgg

SEQ ID NO: 422 - DNA, 19 bp, Artificial Sequence
  Description of Artificial Sequence: Chemically synthesized oligonucleotide
ccaagggcacaaagggttg

SEQ ID NO: 423 - DNA, 19 bp, Artificial Sequence
  Description of Artificial Sequence: Chemically synthesized oligonucleotide
aaccctttgtgcccttggg

SEQ ID NO: 424 - DNA, 19 bp, Artificial Sequence
  Description of Artificial Sequence: Chemically synthesized oligonucleotide
cccaagggcacaaagggtt

SEQ ID NO: 425 - DNA, 19 bp, Artificial Sequence
  Description of Artificial Sequence: Chemically synthesized oligonucleotide
accctttgtgcccttgggc

SEQ ID NO: 426 - DNA, 19 bp, Artificial Sequence
  Description of Artificial Sequence: Chemically synthesized oligonucleotide
gcccaagggcacaaagggt

SEQ ID NO: 427 - DNA, 19 bp, Artificial Sequence
  Description of Artificial Sequence: Chemically synthesized oligonucleotide
ccctttgtgcccttgggct

SEQ ID NO: 428 - DNA, 19 bp, Artificial Sequence
  Description of Artificial Sequence: Chemically synthesized oligonucleotide
agcccaagggcacaaaggg

SEQ ID NO: 429 - DNA, 19 bp, Artificial Sequence
  Description of Artificial Sequence: Chemically synthesized oligonucleotide
cctttgtgcccttgggctc

SEQ ID NO: 430 - DNA, 19 bp, Artificial Sequence
  Description of Artificial Sequence: Chemically synthesized oligonucleotide
gagcccaagggcacaaagg

SEQ ID NO: 431 - DNA, 19 bp, Artificial Sequence
  Description of Artificial Sequence: Chemically synthesized oligonucleotide
ctttgtgcccttgggctct

SEQ ID NO: 432 - DNA, 19 bp, Artificial Sequence
  Description of Artificial Sequence: Chemically synthesized oligonucleotide
agagcccaagggcacaaag

SEQ ID NO: 433 - DNA, 19 bp, Artificial Sequence
  Description of Artificial Sequence: Chemically synthesized oligonucleotide
tttgtgcccttgggctctg

SEQ ID NO: 434 - DNA, 19 bp, Artificial Sequence
  Description of Artificial Sequence: Chemically synthesized oligonucleotide
cagagcccaagggcacaaa

SEQ ID NO: 435 - DNA, 19 bp, Artificial Sequence
  Description of Artificial Sequence: Chemically synthesized oligonucleotide
ttgtgcccttgggctctgg

SEQ ID NO: 436 - DNA, 19 bp, Artificial Sequence
  Description of Artificial Sequence: Chemically synthesized oligonucleotide
ccagagcccaagggcacaa

SEQ ID NO: 437 - DNA, 19 bp, Artificial Sequence
  Description of Artificial Sequence: Chemically synthesized oligonucleotide
tgtgcccttgggctctgga

SEQ ID NO: 438 - DNA, 19 bp, Artificial Sequence
  Description of Artificial Sequence: Chemically synthesized oligonucleotide
tccagagcccaagggcaca

SEQ ID NO: 439 - DNA, 19 bp, Artificial Sequence
  Description of Artificial Sequence: Chemically synthesized oligonucleotide
gtgcccttgggctctggaa

SEQ ID NO: 440 - DNA, 19 bp, Artificial Sequence
  Description of Artificial Sequence: Chemically synthesized oligonucleotide
ttccagagcccaagggcac

SEQ ID NO: 441 - DNA, 19 bp, Artificial Sequence
  Description of Artificial Sequence: Chemically synthesized oligonucleotide
tgcccttgggctctggaag

SEQ ID NO: 442 - DNA, 19 bp, Artificial Sequence
  Description of Artificial Sequence: Chemically synthesized oligonucleotide
cttccagagcccaagggca

SEQ ID NO: 443 - DNA, 19 bp, Artificial Sequence
  Description of Artificial Sequence: Chemically synthesized oligonucleotide
gcccttgggctctggaaga

SEQ ID NO: 444 - DNA, 19 bp, Artificial Sequence
  Description of Artificial Sequence: Chemically synthesized oligonucleotide
tcttccagagcccaagggc

SEQ ID NO: 445 - DNA, 19 bp, Artificial Sequence
  Description of Artificial Sequence: Chemically synthesized oligonucleotide
cccttgggctctggaagag

SEQ ID NO: 446 - DNA, 19 bp, Artificial Sequence
  Description of Artificial Sequence: Chemically synthesized oligonucleotide
ctcttccagagcccaaggg

SEQ ID NO: 447 - DNA, 19 bp, Artificial Sequence
  Description of Artificial Sequence: Chemically synthesized oligonucleotide
ccttgggctctggaagagg

SEQ ID NO: 448 - DNA, 19 bp, Artificial Sequence
  Description of Artificial Sequence: Chemically synthesized oligonucleotide
cctcttccagagcccaagg

SEQ ID NO: 449 - DNA, 19 bp, Artificial Sequence
  Description of Artificial Sequence: Chemically synthesized oligonucleotide
cttgggctctggaagaggt

SEQ ID NO: 450 - DNA, 19 bp, Artificial Sequence
  Description of Artificial Sequence: Chemically synthesized oligonucleotide
acctcttccagagcccaag

SEQ ID NO: 451 - DNA, 19 bp, Artificial Sequence
  Description of Artificial Sequence: Chemically synthesized oligonucleotide
ttgggctctggaagaggtt

SEQ ID NO: 452 - DNA, 19 bp, Artificial Sequence
  Description of Artificial Sequence: Chemically synthesized oligonucleotide
aacctcttccagagcccaa

SEQ ID NO: 453 - DNA, 19 bp, Artificial Sequence
  Description of Artificial Sequence: Chemically synthesized oligonucleotide
tgggctctggaagaggttt

SEQ ID NO: 454 - DNA, 19 bp, Artificial Sequence
  Description of Artificial Sequence: Chemically synthesized oligonucleotide
aaacctcttccagagccca

SEQ ID NO: 455 - DNA, 19 bp, Artificial Sequence
  Description of Artificial Sequence: Chemically synthesized oligonucleotide
gggctctggaagaggtttg

SEQ ID NO: 456 - DNA, 19 bp, Artificial Sequence
  Description of Artificial Sequence: Chemically synthesized oligonucleotide
caaacctcttccagagccc

SEQ ID NO: 457 - DNA, 19 bp, Artificial Sequence
  Description of Artificial Sequence: Chemically synthesized oligonucleotide
ggctctggaagaggtttgg

SEQ ID NO: 458 - DNA, 19 bp, Artificial Sequence
  Description of Artificial Sequence: Chemically synthesized oligonucleotide
ccaaacctcttccagagcc

SEQ ID NO: 459 - DNA, 19 bp, Artificial Sequence
  Description of Artificial Sequence: Chemically synthesized oligonucleotide
gctctggaagaggtttggg

SEQ ID NO: 460 - DNA, 19 bp, Artificial Sequence
  Description of Artificial Sequence: Chemically synthesized oligonucleotide
cccaaacctcttccagagc

SEQ ID NO: 461 - DNA, 19 bp, Artificial Sequence
  Description of Artificial Sequence: Chemically synthesized oligonucleotide
ctctggaagaggtttggga

SEQ ID NO: 462 - DNA, 19 bp, Artificial Sequence
  Description of Artificial Sequence: Chemically synthesized oligonucleotide
tcccaaacctcttccagag

SEQ ID NO: 463 - DNA, 19 bp, Artificial Sequence
  Description of Artificial Sequence: Chemically synthesized oligonucleotide
tctggaagaggtttgggaa

SEQ ID NO: 464 - DNA, 19 bp, Artificial Sequence
  Description of Artificial Sequence: Chemically synthesized oligonucleotide
ttcccaaacctcttccaga

SEQ ID NO: 465 - DNA, 19 bp, Artificial Sequence
  Description of Artificial Sequence: Chemically synthesized oligonucleotide
ctggaagaggtttgggaag

SEQ ID NO: 466 - DNA, 19 bp, Artificial Sequence
  Description of Artificial Sequence: Chemically synthesized oligonucleotide
cttcccaaacctcttccag

SEQ ID NO: 467 - DNA, 19 bp, Artificial Sequence
  Description of Artificial Sequence: Chemically synthesized oligonucleotide
tggaagaggtttgggaagg

SEQ ID NO: 468 - DNA, 19 bp, Artificial Sequence
  Description of Artificial Sequence: Chemically synthesized oligonucleotide
ccttcccaaacctcttcca

SEQ ID NO: 469 - DNA, 19 bp, Artificial Sequence
  Description of Artificial Sequence: Chemically synthesized oligonucleotide
ggaagaggtttgggaaggg

SEQ ID NO: 470 - DNA, 19 bp, Artificial Sequence
  Description of Artificial Sequence: Chemically synthesized oligonucleotide
cccttcccaaacctcttcc

SEQ ID NO: 471 - DNA, 19 bp, Artificial Sequence
  Description of Artificial Sequence: Chemically synthesized oligonucleotide
gaagaggtttgggaagggt

SEQ ID NO: 472 - DNA, 19 bp, Artificial Sequence
  Description of Artificial Sequence: Chemically synthesized oligonucleotide
acccttcccaaacctcttc

SEQ ID NO: 473 - DNA, 19 bp, Artificial Sequence
  Description of Artificial Sequence: Chemically synthesized oligonucleotide
aagaggtttgggaagggtt

SEQ ID NO: 474 - DNA, 19 bp, Artificial Sequence
  Description of Artificial Sequence: Chemically synthesized oligonucleotide
aacccttcccaaacctctt

SEQ ID NO: 475 - DNA, 19 bp, Artificial Sequence
  Description of Artificial Sequence: Chemically synthesized oligonucleotide
agaggtttgggaagggttt

SEQ ID NO: 476 - DNA, 19 bp, Artificial Sequence
  Description of Artificial Sequence: Chemically synthesized oligonucleotide
aaacccttcccaaacctct

SEQ ID NO: 477 - DNA, 19 bp, Artificial Sequence
  Description of Artificial Sequence: Chemically synthesized oligonucleotide
gaggtttgggaagggtttg

SEQ ID NO: 478 - DNA, 19 bp, Artificial Sequence
  Description of Artificial Sequence: Chemically synthesized oligonucleotide
caaacccttcccaaacctc

SEQ ID NO: 479 - DNA, 19 bp, Artificial Sequence
  Description of Artificial Sequence: Chemically synthesized oligonucleotide
aggtttgggaagggtttgg

SEQ ID NO: 480 - DNA, 19 bp, Artificial Sequence
  Description of Artificial Sequence: Chemically synthesized oligonucleotide
ccaaacccttcccaaacct

SEQ ID NO: 481 - DNA, 19 bp, Artificial Sequence
  Description of Artificial Sequence: Chemically synthesized oligonucleotide
ggtttgggaagggtttggg

SEQ ID NO: 482 - DNA, 19 bp, Artificial Sequence
  Description of Artificial Sequence: Chemically synthesized oligonucleotide
cccaaacccttcccaaacc

SEQ ID NO: 483 - DNA, 19 bp, Artificial Sequence
  Description of Artificial Sequence: Chemically synthesized oligonucleotide
gtttgggaagggtttgggg

SEQ ID NO: 484 - DNA, 19 bp, Artificial Sequence
  Description of Artificial Sequence: Chemically synthesized oligonucleotide
ccccaaacccttcccaaac

SEQ ID NO: 485 - DNA, 19 bp, Artificial Sequence
  Description of Artificial Sequence: Chemically synthesized oligonucleotide
tttgggaagggtttggggt

SEQ ID NO: 486 - DNA, 19 bp, Artificial Sequence
  Description of Artificial Sequence: Chemically synthesized oligonucleotide
accccaaacccttcccaaa

SEQ ID NO: 487 - DNA, 19 bp, Artificial Sequence
  Description of Artificial Sequence: Chemically synthesized oligonucleotide
ttgggaagggtttggggtg

SEQ ID NO: 488 - DNA, 19 bp, Artificial Sequence
  Description of Artificial Sequence: Chemically synthesized oligonucleotide
caccccaaacccttcccaa

SEQ ID NO: 489 - DNA, 19 bp, Artificial Sequence
  Description of Artificial Sequence: Chemically synthesized oligonucleotide
tgggaagggtttggggtgg

SEQ ID NO: 490 - DNA, 19 bp, Artificial Sequence
  Description of Artificial Sequence: Chemically synthesized oligonucleotide
ccaccccaaacccttccca

SEQ ID NO: 491 - DNA, 19 bp, Artificial Sequence
  Description of Artificial Sequence: Chemically synthesized oligonucleotide
gggaagggtttggggtgga

SEQ ID NO: 492 - DNA, 19 bp, Artificial Sequence
  Description of Artificial Sequence: Chemically synthesized oligonucleotide
tccaccccaaacccttccc

SEQ ID NO: 493 - DNA, 19 bp, Artificial Sequence
  Description of Artificial Sequence: Chemically synthesized oligonucleotide
ggaagggtttggggtggaa

SEQ ID NO: 494 - DNA, 19 bp, Artificial Sequence
  Description of Artificial Sequence: Chemically synthesized oligonucleotide
ttccaccccaaacccttcc

SEQ ID NO: 495 - DNA, 19 bp, Artificial Sequence
  Description of Artificial Sequence: Chemically synthesized oligonucleotide
gaagggtttggggtggaag

SEQ ID NO: 496 - DNA, 19 bp, Artificial Sequence
  Description of Artificial Sequence: Chemically synthesized oligonucleotide
cttccaccccaaacccttc

SEQ ID NO: 497 - DNA, 19 bp, Artificial Sequence
  Description of Artificial Sequence: Chemically synthesized oligonucleotide
aagggtttggggtggaaga

SEQ ID NO: 498 - DNA, 19 bp, Artificial Sequence
  Description of Artificial Sequence: Chemically synthesized oligonucleotide
tcttccaccccaaaccctt

SEQ ID NO: 499 - DNA, 19 bp, Artificial Sequence
  Description of Artificial Sequence: Chemically synthesized oligonucleotide
agggtttggggtggaagat

SEQ ID NO: 500 - DNA, 19 bp, Artificial Sequence
  Description of Artificial Sequence: Chemically synthesized oligonucleotide
atcttccaccccaaaccct

SEQ ID NO: 501 - DNA, 19 bp, Artificial Sequence
  Description of Artificial Sequence: Chemically synthesized oligonucleotide
gggtttggggtggaagatg

SEQ ID NO: 502 - DNA, 19 bp, Artificial Sequence
  Description of Artificial Sequence: Chemically synthesized oligonucleotide
catcttccaccccaaaccc

SEQ ID NO: 503 - DNA, 19 bp, Artificial Sequence
  Description of Artificial Sequence: Chemically synthesized oligonucleotide
ggtttggggtggaagatgg

SEQ ID NO: 504 - DNA, 19 bp, Artificial Sequence
  Description of Artificial Sequence: Chemically synthesized oligonucleotide
ccatcttccaccccaaacc

SEQ ID NO: 505 - DNA, 19 bp, Artificial Sequence
  Description of Artificial Sequence: Chemically synthesized oligonucleotide
gtttggggtggaagatggc

SEQ ID NO: 506 - DNA, 19 bp, Artificial Sequence
  Description of Artificial Sequence: Chemically synthesized oligonucleotide
gccatcttccaccccaaac

SEQ ID NO: 507 - DNA, 19 bp, Artificial Sequence
  Description of Artificial Sequence: Chemically synthesized oligonucleotide
tttggggtggaagatggca

SEQ ID NO: 508 - DNA, 19 bp, Artificial Sequence
  Description of Artificial Sequence: Chemically synthesized oligonucleotide
tgccatcttccaccccaaa

SEQ ID NO: 509 - DNA, 19 bp, Artificial Sequence
  Description of Artificial Sequence: Chemically synthesized oligonucleotide
ttggggtggaagatggcaa

SEQ ID NO: 510 - DNA, 19 bp, Artificial Sequence
  Description of Artificial Sequence: Chemically synthesized oligonucleotide
ttgccatcttccaccccaa

SEQ ID NO: 511 - DNA, 19 bp, Artificial Sequence
  Description of Artificial Sequence: Chemically synthesized oligonucleotide
tggggtggaagatggcaaa

SEQ ID NO: 512 - DNA, 19 bp, Artificial Sequence
  Description of Artificial Sequence: Chemically synthesized oligonucleotide
tttgccatcttccacccca

SEQ ID NO: 513 - DNA, 19 bp, Artificial Sequence
  Description of Artificial Sequence: Chemically synthesized oligonucleotide
ggggtggaagatggcaaag

SEQ ID NO: 514 - DNA, 19 bp, Artificial Sequence
  Description of Artificial Sequence: Chemically synthesized oligonucleotide
ctttgccatcttccacccc

SEQ ID NO: 515 - DNA, 19 bp, Artificial Sequence
  Description of Artificial Sequence: Chemically synthesized oligonucleotide
gggtggaagatggcaaaga

SEQ ID NO: 516 - DNA, 19 bp, Artificial Sequence
  Description of Artificial Sequence: Chemically synthesized oligonucleotide
tctttgccatcttccaccc

SEQ ID NO: 517 - DNA, 19 bp, Artificial Sequence
  Description of Artificial Sequence: Chemically synthesized oligonucleotide
ggtggaagatggcaaagag

SEQ ID NO: 518 - DNA, 19 bp, Artificial Sequence
  Description of Artificial Sequence: Chemically synthesized oligonucleotide
ctctttgccatcttccacc

SEQ ID NO: 519 - DNA, 19 bp, Artificial Sequence
  Description of Artificial Sequence: Chemically synthesized oligonucleotide
gtggaagatggcaaagagc

SEQ ID NO: 520 - DNA, 19 bp, Artificial Sequence
  Description of Artificial Sequence: Chemically synthesized oligonucleotide
gctctttgccatcttccac

SEQ ID NO: 521 - DNA, 19 bp, Artificial Sequence
  Description of Artificial Sequence: Chemically synthesized oligonucleotide
tggaagatggcaaagagca

SEQ ID NO: 522 - DNA, 19 bp, Artificial Sequence
  Description of Artificial Sequence: Chemically synthesized oligonucleotide
tgctctttgccatcttcca

SEQ ID NO: 523 - DNA, 19 bp, Artificial Sequence
  Description of Artificial Sequence: Chemically synthesized oligonucleotide
ggaagatggcaaagagcag

SEQ ID NO: 524 - DNA, 19 bp, Artificial Sequence
  Description of Artificial Sequence: Chemically synthesized oligonucleotide
ctgctctttgccatcttcc

SEQ ID NO: 525 - DNA, 19 bp, Artificial Sequence
  Description of Artificial Sequence: Chemically synthesized oligonucleotide
gaagatggcaaagagcagc

SEQ ID NO: 526 - DNA, 19 bp, Artificial Sequence
  Description of Artificial Sequence: Chemically synthesized oligonucleotide
gctgctctttgccatcttc

SEQ ID NO: 527 - DNA, 19 bp, Artificial Sequence
  Description of Artificial Sequence: Chemically synthesized oligonucleotide
aagatggcaaagagcagct

SEQ ID NO: 528 - DNA, 19 bp, Artificial Sequence
  Description of Artificial Sequence: Chemically synthesized oligonucleotide
agctgctctttgccatctt

SEQ ID NO: 529 - DNA, 19 bp, Artificial Sequence
  Description of Artificial Sequence: Chemically synthesized oligonucleotide
agatggcaaagagcagctt

SEQ ID NO: 530 - DNA, 19 bp, Artificial Sequence
  Description of Artificial Sequence: Chemically synthesized oligonucleotide
aagctgctctttgccatct

SEQ ID NO: 531 - DNA, 19 bp, Artificial Sequence
  Description of Artificial Sequence: Chemically synthesized oligonucleotide
gatggcaaagagcagcttg

SEQ ID NO: 532 - DNA, 19 bp, Artificial Sequence
  Description of Artificial Sequence: Chemically synthesized oligonucleotide
caagctgctctttgccatc

SEQ ID NO: 533 - DNA, 19 bp, Artificial Sequence
  Description of Artificial Sequence: Chemically synthesized oligonucleotide
atggcaaagagcagcttgg

SEQ ID NO: 534 - DNA, 19 bp, Artificial Sequence
  Description of Artificial Sequence: Chemically synthesized oligonucleotide
ccaagctgctctttgccat

SEQ ID NO: 535 - DNA, 19 bp, Artificial Sequence
  Description of Artificial Sequence: Chemically synthesized oligonucleotide
tggcaaagagcagcttggc

SEQ ID NO: 536 - DNA, 19 bp, Artificial Sequence
  Description of Artificial Sequence: Chemically synthesized oligonucleotide
gccaagctgctctttgcca

SEQ ID NO: 537 - DNA, 19 bp, Artificial Sequence
  Description of Artificial Sequence: Chemically synthesized oligonucleotide
ggcaaagagcagcttggcc

SEQ ID NO: 538 - DNA, 19 bp, Artificial Sequence
  Description of Artificial Sequence: Chemically synthesized oligonucleotide
ggccaagctgctctttgcc

SEQ ID NO: 539 - DNA, 19 bp, Artificial Sequence
  Description of Artificial Sequence: Chemically synthesized oligonucleotide
gcaaagagcagcttggcca

SEQ ID NO: 540 - DNA, 19 bp, Artificial Sequence
  Description of Artificial Sequence: Chemically synthesized oligonucleotide
tggccaagctgctctttgc

SEQ ID NO: 541 - DNA, 19 bp, Artificial Sequence
  Description of Artificial Sequence: Chemically synthesized oligonucleotide
caaagagcagcttggccag

SEQ ID NO: 542 - DNA, 19 bp, Artificial Sequence
  Description of Artificial Sequence: Chemically synthesized oligonucleotide
ctggccaagctgctctttg

SEQ ID NO: 543 - DNA, 19 bp, Artificial Sequence
  Description of Artificial Sequence: Chemically synthesized oligonucleotide
aaagagcagcttggccagg

SEQ ID NO: 544 - DNA, 19 bp, Artificial Sequence
  Description of Artificial Sequence: Chemically synthesized oligonucleotide
cctggccaagctgctcttt

SEQ ID NO: 545 - DNA, 19 bp, Artificial Sequence
  Description of Artificial Sequence: Chemically synthesized oligonucleotide
aagagcagcttggccaggt

SEQ ID NO: 546 - DNA, 19 bp, Artificial Sequence
  Description of Artificial Sequence: Chemically synthesized oligonucleotide
acctggccaagctgctctt

SEQ ID NO: 547 - DNA, 19 bp, Artificial Sequence
  Description of Artificial Sequence: Chemically synthesized oligonucleotide
agagcagcttggccaggtg

SEQ ID NO: 548 - DNA, 19 bp, Artificial Sequence
  Description of Artificial Sequence: Chemically synthesized oligonucleotide
cacctggccaagctgctct

SEQ ID NO: 549 - DNA, 19 bp, Artificial Sequence
  Description of Artificial Sequence: Chemically synthesized oligonucleotide
gagcagcttggccaggtga

SEQ ID NO: 550 - DNA, 19 bp, Artificial Sequence
  Description of Artificial Sequence: Chemically synthesized oligonucleotide
tcacctggccaagctgctc

SEQ ID NO: 551 - DNA, 19 bp, Artificial Sequence
  Description of Artificial Sequence: Chemically synthesized oligonucleotide
agcagcttggccaggtgag

SEQ ID NO: 552 - DNA, 19 bp, Artificial Sequence
  Description of Artificial Sequence: Chemically synthesized oligonucleotide
ctcacctggccaagctgct

SEQ ID NO: 553 - DNA, 19 bp, Artificial Sequence
  Description of Artificial Sequence: Chemically synthesized oligonucleotide
gcagcttggccaggtgagg

SEQ ID NO: 554 - DNA, 19 bp, Artificial Sequence
  Description of Artificial Sequence: Chemically synthesized oligonucleotide
cctcacctggccaagctgc

SEQ ID NO: 555 - DNA, 19 bp, Artificial Sequence
  Description of Artificial Sequence: Chemically synthesized oligonucleotide
cagcttggccaggtgagga

SEQ ID NO: 556 - DNA, 19 bp, Artificial Sequence
  Description of Artificial Sequence: Chemically synthesized oligonucleotide
tcctcacctggccaagctg

SEQ ID NO: 557 - DNA, 19 bp, Artificial Sequence
  Description of Artificial Sequence: Chemically synthesized oligonucleotide
agcttggccaggtgaggat

SEQ ID NO: 558 - DNA, 19 bp, Artificial Sequence
  Description of Artificial Sequence: Chemically synthesized oligonucleotide
atcctcacctggccaagct

SEQ ID NO: 559 - DNA, 19 bp, Artificial Sequence
  Description of Artificial Sequence: Chemically synthesized oligonucleotide
gcttggccaggtgaggatg

SEQ ID NO: 560 - DNA, 19 bp, Artificial Sequence
  Description of Artificial Sequence: Chemically synthesized oligonucleotide
catcctcacctggccaagc

SEQ ID NO: 561 - DNA, 19 bp, Artificial Sequence
  Description of Artificial Sequence: Chemically synthesized oligonucleotide
cttggccaggtgaggatga

SEQ ID NO: 562 - DNA, 19 bp, Artificial Sequence
  Description of Artificial Sequence: Chemically synthesized oligonucleotide
tcatcctcacctggccaag

SEQ ID NO: 563 - DNA, 19 bp, Artificial Sequence
  Description of Artificial Sequence: Chemically synthesized oligonucleotide
ttggccaggtgaggatgag

SEQ ID NO: 564 - DNA, 19 bp, Artificial Sequence
  Description of Artificial Sequence: Chemically synthesized oligonucleotide
ctcatcctcacctggccaa

SEQ ID NO: 565 - DNA, 19 bp, Artificial Sequence
  Description of Artificial Sequence: Chemically synthesized oligonucleotide
tggccaggtgaggatgagg

SEQ ID NO: 566 - DNA, 19 bp, Artificial Sequence
  Description of Artificial Sequence: Chemically synthesized oligonucleotide
cctcatcctcacctggcca

SEQ ID NO: 567 - DNA, 19 bp, Artificial Sequence
  Description of Artificial Sequence: Chemically synthesized oligonucleotide
ggccaggtgaggatgaggc

SEQ ID NO: 568 - DNA, 19 bp, Artificial Sequence
  Description of Artificial Sequence: Chemically synthesized oligonucleotide
gcctcatcctcacctggcc

SEQ ID NO: 569 - DNA, 19 bp, Artificial Sequence
  Description of Artificial Sequence: Chemically synthesized oligonucleotide
gccaggtgaggatgaggca

SEQ ID NO: 570 - DNA, 19 bp, Artificial Sequence
  Description of Artificial Sequence: Chemically synthesized oligonucleotide
tgcctcatcctcacctggc

SEQ ID NO: 571 - DNA, 19 bp, Artificial Sequence
  Description of Artificial Sequence: Chemically synthesized oligonucleotide
ccaggtgaggatgaggcag

SEQ ID NO: 572 - DNA, 19 bp, Artificial Sequence
  Description of Artificial Sequence: Chemically synthesized oligonucleotide
ctgcctcatcctcacctgg

SEQ ID NO: 573 - DNA, 19 bp, Artificial Sequence
  Description of Artificial Sequence: Chemically synthesized oligonucleotide
caggtgaggatgaggcagg

SEQ ID NO: 574 - DNA, 19 bp, Artificial Sequence
  Description of Artificial Sequence: Chemically synthesized oligonucleotide
cctgcctcatcctcacctg

SEQ ID NO: 575 - DNA, 19 bp, Artificial Sequence
  Description of Artificial Sequence: Chemically synthesized oligonucleotide
aggtgaggatgaggcaggg

SEQ ID NO: 576 - DNA, 19 bp, Artificial Sequence
  Description of Artificial Sequence: Chemically synthesized oligonucleotide
ccctgcctcatcctcacct

SEQ ID NO: 577 - DNA, 19 bp, Artificial Sequence
  Description of Artificial Sequence: Chemically synthesized oligonucleotide
ggtgaggatgaggcagggc

SEQ ID NO: 578 - DNA, 19 bp, Artificial Sequence
  Description of Artificial Sequence: Chemically synthesized oligonucleotide
gccctgcctcatcctcacc

SEQ ID NO: 579 - DNA, 19 bp, Artificial Sequence
  Description of Artificial Sequence: Chemically synthesized oligonucleotide
gtgaggatgaggcagggca

SEQ ID NO: 580 - DNA, 19 bp, Artificial Sequence
  Description of Artificial Sequence: Chemically synthesized oligonucleotide
tgccctgcctcatcctcac

SEQ ID NO: 581 - DNA, 19 bp, Artificial Sequence
  Description of Artificial Sequence: Chemically synthesized oligonucleotide
tgaggatgaggcagggcag

SEQ ID NO: 582 - DNA, 19 bp, Artificial Sequence
  Description of Artificial Sequence: Chemically synthesized oligonucleotide
ctgccctgcctcatcctca

SEQ ID NO: 583 - DNA, 19 bp, Artificial Sequence
  Description of Artificial Sequence: Chemically synthesized oligonucleotide
gaggatgaggcagggcaga

SEQ ID NO: 584 - DNA, 19 bp, Artificial Sequence
  Description of Artificial Sequence: Chemically synthesized oligonucleotide
tctgccctgcctcatcctc

SEQ ID NO: 585 - DNA, 19 bp, Artificial Sequence
  Description of Artificial Sequence: Chemically synthesized oligonucleotide
aggatgaggcagggcagac

SEQ ID NO: 586 - DNA, 19 bp, Artificial Sequence
  Description of Artificial Sequence: Chemically synthesized oligonucleotide
gtctgccctgcctcatcct

SEQ ID NO: 587 - DNA, 19 bp, Artificial Sequence
  Description of Artificial Sequence: Chemically synthesized oligonucleotide
ggatgaggcagggcagaca

SEQ ID NO: 588 - DNA, 19 bp, Artificial Sequence
  Description of Artificial Sequence: Chemically synthesized oligonucleotide
tgtctgccctgcctcatcc

SEQ ID NO: 589 - DNA, 19 bp, Artificial Sequence
  Description of Artificial Sequence: Chemically synthesized oligonucleotide
gatgaggcagggcagacac

SEQ ID NO: 590 - DNA, 19 bp, Artificial Sequence
  Description of Artificial Sequence: Chemically synthesized oligonucleotide
gtgtctgccctgcctcatc

SEQ ID NO: 591 - DNA, 19 bp, Artificial Sequence
  Description of Artificial Sequence: Chemically synthesized oligonucleotide
atgaggcagggcagacaca

SEQ ID NO: 592 - DNA, 19 bp, Artificial Sequence
  Description of Artificial Sequence: Chemically synthesized oligonucleotide
tgtgtctgccctgcctcat

SEQ ID NO: 593 - DNA, 19 bp, Artificial Sequence
  Description of Artificial Sequence: Chemically synthesized oligonucleotide
tgaggcagggcagacacag

SEQ ID NO: 594 - DNA, 19 bp, Artificial Sequence
  Description of Artificial Sequence: Chemically synthesized oligonucleotide
ctgtgtctgccctgcctca

SEQ ID NO: 595 - DNA, 19 bp, Artificial Sequence
  Description of Artificial Sequence: Chemically synthesized oligonucleotide
gaggcagggcagacacagg

SEQ ID NO: 596 - DNA, 19 bp, Artificial Sequence
  Description of Artificial Sequence: Chemically synthesized oligonucleotide
cctgtgtctgccctgcctc

SEQ ID NO: 597 - DNA, 19 bp, Artificial Sequence
  Description of Artificial Sequence: Chemically synthesized oligonucleotide
aggcagggcagacacaggc

SEQ ID NO: 598 - DNA, 19 bp, Artificial Sequence
  Description of Artificial Sequence: Chemically synthesized oligonucleotide
gcctgtgtctgccctgcct

SEQ ID NO: 599 - DNA, 19 bp, Artificial Sequence
  Description of Artificial Sequence: Chemically synthesized oligonucleotide
ggcagggcagacacaggcc

SEQ ID NO: 600 - DNA, 19 bp, Artificial Sequence
  Description of Artificial Sequence: Chemically synthesized oligonucleotide
ggcctgtgtctgccctgcc

SEQ ID NO: 601 - DNA, 19 bp, Artificial Sequence
  Description of Artificial Sequence: Chemically synthesized oligonucleotide
gcagggcagacacaggcca

SEQ ID NO: 602 - DNA, 19 bp, Artificial Sequence
  Description of Artificial Sequence: Chemically synthesized oligonucleotide
tggcctgtgtctgccctgc

SEQ ID NO: 603 - DNA, 19 bp, Artificial Sequence
  Description of Artificial Sequence: Chemically synthesized oligonucleotide
cagggcagacacaggccag

SEQ ID NO: 604 - DNA, 19 bp, Artificial Sequence
  Description of Artificial Sequence: Chemically synthesized oligonucleotide
ctggcctgtgtctgccctg

SEQ ID NO: 605 - DNA, 19 bp, Artificial Sequence
  Description of Artificial Sequence: Chemically synthesized oligonucleotide
agggcagacacaggccagt

SEQ ID NO: 606 - DNA, 19 bp, Artificial Sequence
  Description of Artificial Sequence: Chemically synthesized oligonucleotide
actggcctgtgtctgccct

SEQ ID NO: 607 - DNA, 19 bp, Artificial Sequence
  Description of Artificial Sequence: Chemically synthesized oligonucleotide
gggcagacacaggccagtg

SEQ ID NO: 608 - DNA, 19 bp, Artificial Sequence
  Description of Artificial Sequence: Chemically synthesized oligonucleotide
cactggcctgtgtctgccc

SEQ ID NO: 609 - DNA, 19 bp, Artificial Sequence
  Description of Artificial Sequence: Chemically synthesized oligonucleotide
ggcagacacaggccagtgg

SEQ ID NO: 610 - DNA, 19 bp, Artificial Sequence
  Description of Artificial Sequence: Chemically synthesized oligonucleotide
ccactggcctgtgtctgcc

SEQ ID NO: 611 - DNA, 19 bp, Artificial Sequence
  Description of Artificial Sequence: Chemically synthesized oligonucleotide
gcagacacaggccagtggg

SEQ ID NO: 612 - DNA, 19 bp, Artificial Sequence
  Description of Artificial Sequence: Chemically synthesized oligonucleotide
cccactggcctgtgtctgc

SEQ ID NO: 613 - DNA, 19 bp, Artificial Sequence
  Description of Artificial Sequence: Chemically synthesized oligonucleotide
cagacacaggccagtgggg

SEQ ID NO: 614 - DNA, 19 bp, Artificial Sequence
  Description of Artificial Sequence: Chemically synthesized oligonucleotide
ccccactggcctgtgtctg

SEQ ID NO: 615 - DNA, 19 bp, Artificial Sequence
  Description of Artificial Sequence: Chemically synthesized oligonucleotide
agacacaggccagtggggc

SEQ ID NO: 616 - DNA, 19 bp, Artificial Sequence
  Description of Artificial Sequence: Chemically synthesized oligonucleotide
gccccactggcctgtgtct

SEQ ID NO: 617 - DNA, 19 bp, Artificial Sequence
  Description of Artificial Sequence: Chemically synthesized oligonucleotide
gacacaggccagtggggcg

SEQ ID NO: 618 - DNA, 19 bp, Artificial Sequence
  Description of Artificial Sequence: Chemically synthesized oligonucleotide
cgccccactggcctgtgtc

SEQ ID NO: 619 - DNA, 19 bp, Artificial Sequence
  Description of Artificial Sequence: Chemically synthesized oligonucleotide
acacaggccagtggggcgt

SEQ ID NO: 620 - DNA, 19 bp, Artificial Sequence
  Description of Artificial Sequence: Chemically synthesized oligonucleotide
acgccccactggcctgtgt

SEQ ID NO: 621 - DNA, 19 bp, Artificial Sequence
  Description of Artificial Sequence: Chemically synthesized oligonucleotide
cacaggccagtggggcgtg

SEQ ID NO: 622 - DNA, 19 bp, Artificial Sequence
  Description of Artificial Sequence: Chemically synthesized oligonucleotide
cacgccccactggcctgtg

SEQ ID NO: 623 - DNA, 19 bp, Artificial Sequence
  Description of Artificial Sequence: Chemically synthesized oligonucleotide
acaggccagtggggcgtgc

SEQ ID NO: 624 - DNA, 19 bp, Artificial Sequence
  Description of Artificial Sequence: Chemically synthesized oligonucleotide
gcacgccccactggcctgt

SEQ ID NO: 625 - DNA, 19 bp, Artificial Sequence
  Description of Artificial Sequence: Chemically synthesized oligonucleotide
caggccagtggggcgtgcc

SEQ ID NO: 626 - DNA, 19 bp, Artificial Sequence
  Description of Artificial Sequence: Chemically synthesized oligonucleotide
ggcacgccccactggcctg

SEQ ID NO: 627 - DNA, 19 bp, Artificial Sequence
  Description of Artificial Sequence: Chemically synthesized oligonucleotide
aggccagtggggcgtgcca

SEQ ID NO: 628 - DNA, 19 bp, Artificial Sequence
  Description of Artificial Sequence: Chemically synthesized oligonucleotide
tggcacgccccactggcct

SEQ ID NO: 629 - DNA, 19 bp, Artificial Sequence
  Description of Artificial Sequence: Chemically synthesized oligonucleotide
ggccagtggggcgtgccat

SEQ ID NO: 630 - DNA, 19 bp, Artificial Sequence
  Description of Artificial Sequence: Chemically synthesized oligonucleotide
atggcacgccccactggcc

SEQ ID NO: 631 - DNA, 19 bp, Artificial Sequence
  Description of Artificial Sequence: Chemically synthesized oligonucleotide
gccagtggggcgtgccatg

SEQ ID NO: 632 - DNA, 19 bp, Artificial Sequence
  Description of Artificial Sequence: Chemically synthesized oligonucleotide
catggcacgccccactggc

SEQ ID NO: 633 - DNA, 19 bp, Artificial Sequence
  Description of Artificial Sequence: Chemically synthesized oligonucleotide
ccagtggggcgtgccatgt

SEQ ID NO: 634 - DNA, 19 bp, Artificial Sequence
  Description of Artificial Sequence: Chemically synthesized oligonucleotide
acatggcacgccccactgg

SEQ ID NO: 635 - DNA, 19 bp, Artificial Sequence
  Description of Artificial Sequence: Chemically synthesized oligonucleotide
cagtggggcgtgccatgtg

SEQ ID NO: 636 - DNA, 19 bp, Artificial Sequence
  Description of Artificial Sequence: Chemically synthesized oligonucleotide
cacatggcacgccccactg

SEQ ID NO: 637 - DNA, 19 bp, Artificial Sequence
  Description of Artificial Sequence: Chemically synthesized oligonucleotide
agtggggcgtgccatgtgc

SEQ ID NO: 638 - DNA, 19 bp, Artificial Sequence
  Description of Artificial Sequence: Chemically synthesized oligonucleotide
gcacatggcacgccccact

SEQ ID NO: 639 - DNA, 19 bp, Artificial Sequence
  Description of Artificial Sequence: Chemically synthesized oligonucleotide
gtggggcgtgccatgtgcc

SEQ ID NO: 640 - DNA, 19 bp, Artificial Sequence
  Description of Artificial Sequence: Chemically synthesized oligonucleotide
ggcacatggcacgccccac

SEQ ID NO: 641 - DNA, 19 bp, Artificial Sequence
  Description of Artificial Sequence: Chemically synthesized oligonucleotide
tggggcgtgccatgtgcca

SEQ ID NO: 642 - DNA, 19 bp, Artificial Sequence
  Description of Artificial Sequence: Chemically synthesized oligonucleotide
tggcacatggcacgcccca

SEQ ID NO: 643 - DNA, 19 bp, Artificial Sequence
  Description of Artificial Sequence: Chemically synthesized oligonucleotide
ggggcgtgccatgtgccac

SEQ ID NO: 644 - DNA, 19 bp, Artificial Sequence
  Description of Artificial Sequence: Chemically synthesized oligonucleotide
gtggcacatggcacgcccc

SEQ ID NO: 645 - DNA, 19 bp, Artificial Sequence
  Description of Artificial Sequence: Chemically synthesized oligonucleotide
gggcgtgccatgtgccaca

SEQ ID NO: 646 - DNA, 19 bp, Artificial Sequence
  Description of Artificial Sequence: Chemically synthesized oligonucleotide
tgtggcacatggcacgccc

SEQ ID NO: 647 - DNA, 19 bp, Artificial Sequence
  Description of Artificial Sequence: Chemically synthesized oligonucleotide
ggcgtgccatgtgccacag

SEQ ID NO: 648 - DNA, 19 bp, Artificial Sequence
  Description of Artificial Sequence: Chemically synthesized oligonucleotide
ctgtggcacatggcacgcc

SEQ ID NO: 649 - DNA, 19 bp, Artificial Sequence
  Description of Artificial Sequence: Chemically synthesized oligonucleotide
gcgtgccatgtgccacaga

SEQ ID NO: 650 - DNA, 19 bp, Artificial Sequence
  Description of Artificial Sequence: Chemically synthesized oligonucleotide
tctgtggcacatggcacgc

SEQ ID NO: 651 - DNA, 19 bp, Artificial Sequence
  Description of Artificial Sequence: Chemically synthesized oligonucleotide
cgtgccatgtgccacagat

SEQ ID NO: 652 - DNA, 19 bp, Artificial Sequence
  Description of Artificial Sequence: Chemically synthesized oligonucleotide
atctgtggcacatggcacg

SEQ ID NO: 653 - DNA, 19 bp, Artificial Sequence
  Description of Artificial Sequence: Chemically synthesized oligonucleotide
gtgccatgtgccacagatg

SEQ ID NO: 654 - DNA, 19 bp, Artificial Sequence
  Description of Artificial Sequence: Chemically synthesized oligonucleotide
catctgtggcacatggcac

SEQ ID NO: 655 - DNA, 19 bp, Artificial Sequence
  Description of Artificial Sequence: Chemically synthesized oligonucleotide
tgccatgtgccacagatgg

SEQ ID NO: 656 - DNA, 19 bp, Artificial Sequence
  Description of Artificial Sequence: Chemically synthesized oligonucleotide
ccatctgtggcacatggca

SEQ ID NO: 657 - DNA, 19 bp, Artificial Sequence
  Description of Artificial Sequence: Chemically synthesized oligonucleotide
gccatgtgccacagatgga

SEQ ID NO: 658 - DNA, 19 bp, Artificial Sequence
  Description of Artificial Sequence: Chemically synthesized oligonucleotide
tccatctgtggcacatggc

SEQ ID NO: 659 - DNA, 19 bp, Artificial Sequence
  Description of Artificial Sequence: Chemically synthesized oligonucleotide
ccatgtgccacagatggag

SEQ ID NO: 660 - DNA, 19 bp, Artificial Sequence
  Description of Artificial Sequence: Chemically synthesized oligonucleotide
ctccatctgtggcacatgg

SEQ ID NO: 661 - DNA, 19 bp, Artificial Sequence
  Description of Artificial Sequence: Chemically synthesized oligonucleotide
catgtgccacagatggaga

SEQ ID NO: 662 - DNA, 19 bp, Artificial Sequence
  Description of Artificial Sequence: Chemically synthesized oligonucleotide
tctccatctgtggcacatg

SEQ ID NO: 663 - DNA, 19 bp, Artificial Sequence
  Description of Artificial Sequence: Chemically synthesized oligonucleotide
atgtgccacagatggagag

SEQ ID NO: 664 - DNA, 19 bp, Artificial Sequence
  Description of Artificial Sequence: Chemically synthesized oligonucleotide
ctctccatctgtggcacat

SEQ ID NO: 665 - DNA, 19 bp, Artificial Sequence
  Description of Artificial Sequence: Chemically synthesized oligonucleotide
tgtgccacagatggagagg

SEQ ID NO: 666 - DNA, 19 bp, Artificial Sequence
  Description of Artificial Sequence: Chemically synthesized oligonucleotide
cctctccatctgtggcaca

SEQ ID NO: 667 - DNA, 19 bp, Artificial Sequence
  Description of Artificial Sequence: Chemically synthesized oligonucleotide
gtgccacagatggagagga

SEQ ID NO: 668 - DNA, 19 bp, Artificial Sequence
  Description of Artificial Sequence: Chemically synthesized oligonucleotide
tcctctccatctgtggcac

SEQ ID NO: 669 - DNA, 19 bp, Artificial Sequence
  Description of Artificial Sequence: Chemically synthesized oligonucleotide
tgccacagatggagaggac

SEQ ID NO: 670 - DNA, 19 bp, Artificial Sequence
  Description of Artificial Sequence: Chemically synthesized oligonucleotide
gtcctctccatctgtggca

SEQ ID NO: 671 - DNA, 19 bp, Artificial Sequence
  Description of Artificial Sequence: Chemically synthesized oligonucleotide
gccacagatggagaggacc

SEQ ID NO: 672 - DNA, 19 bp, Artificial Sequence
  Description of Artificial Sequence: Chemically synthesized oligonucleotide
ggtcctctccatctgtggc

SEQ ID NO: 673 - DNA, 19 bp, Artificial Sequence
  Description of Artificial Sequence: Chemically synthesized oligonucleotide
ccacagatggagaggacca

SEQ ID NO: 674 - DNA, 19 bp, Artificial Sequence
  Description of Artificial Sequence: Chemically synthesized oligonucleotide
tggtcctctccatctgtgg

SEQ ID NO: 675 - DNA, 19 bp, Artificial Sequence
  Description of Artificial Sequence: Chemically synthesized oligonucleotide
cacagatggagaggaccag

SEQ ID NO: 676 - DNA, 19 bp, Artificial Sequence
  Description of Artificial Sequence: Chemically synthesized oligonucleotide
ctggtcctctccatctgtg

SEQ ID NO: 677 - DNA, 19 bp, Artificial Sequence
  Description of Artificial Sequence: Chemically synthesized oligonucleotide
acagatggagaggaccagg

SEQ ID NO: 678 - DNA, 19 bp, Artificial Sequence
  Description of Artificial Sequence: Chemically synthesized oligonucleotide
cctggtcctctccatctgt

SEQ ID NO: 679 - DNA, 19 bp, Artificial Sequence
  Description of Artificial Sequence: Chemically synthesized oligonucleotide
cagatggagaggaccagga

SEQ ID NO: 680 - DNA, 19 bp, Artificial Sequence
  Description of Artificial Sequence: Chemically synthesized oligonucleotide
tcctggtcctctccatctg

SEQ ID NO: 681 - DNA, 19 bp, Artificial Sequence
  Description of Artificial Sequence: Chemically synthesized oligonucleotide
agatggagaggaccaggag

SEQ ID NO: 682 - DNA, 19 bp, Artificial Sequence
  Description of Artificial Sequence: Chemically synthesized oligonucleotide
ctcctggtcctctccatct

SEQ ID NO: 683 - DNA, 19 bp, Artificial Sequence
  Description of Artificial Sequence: Chemically synthesized oligonucleotide
gatggagaggaccaggagc

SEQ ID NO: 684 - DNA, 19 bp, Artificial Sequence
  Description of Artificial Sequence: Chemically synthesized oligonucleotide
gctcctggtcctctccatc

SEQ ID NO: 685 - DNA, 19 bp, Artificial Sequence
  Description of Artificial Sequence: Chemically synthesized oligonucleotide
atggagaggaccaggagcc

SEQ ID NO: 686 - DNA, 19 bp, Artificial Sequence
  Description of Artificial Sequence: Chemically synthesized oligonucleotide
ggctcctggtcctctccat

SEQ ID NO: 687 - DNA, 19 bp, Artificial Sequence
  Description of Artificial Sequence: Chemically synthesized oligonucleotide
tggagaggaccaggagcca

SEQ ID NO: 688 - DNA, 19 bp, Artificial Sequence
  Description of Artificial Sequence: Chemically synthesized oligonucleotide
tggctcctggtcctctcca

SEQ ID NO: 689 - DNA, 19 bp, Artificial Sequence
  Description of Artificial Sequence: Chemically synthesized oligonucleotide
ggagaggaccaggagccag

SEQ ID NO: 690 - DNA, 19 bp, Artificial Sequence
  Description of Artificial Sequence: Chemically synthesized oligonucleotide
ctggctcctggtcctctcc

SEQ ID NO: 691 - DNA, 19 bp, Artificial Sequence
  Description of Artificial Sequence: Chemically synthesized oligonucleotide
gagaggaccaggagccagt

SEQ ID NO: 692 - DNA, 19 bp, Artificial Sequence
  Description of Artificial Sequence: Chemically synthesized oligonucleotide
actggctcctggtcctctc

SEQ ID NO: 693 - DNA, 19 bp, Artificial Sequence
  Description of Artificial Sequence: Chemically synthesized oligonucleotide
agaggaccaggagccagtg

SEQ ID NO: 694 - DNA, 19 bp, Artificial Sequence
  Description of Artificial Sequence: Chemically synthesized oligonucleotide
cactggctcctggtcctct

SEQ ID NO: 695 - DNA, 19 bp, Artificial Sequence
  Description of Artificial Sequence: Chemically synthesized oligonucleotide
gaggaccaggagccagtgg

SEQ ID NO: 696 - DNA, 19 bp, Artificial Sequence
  Description of Artificial Sequence: Chemically synthesized oligonucleotide
ccactggctcctggtcctc

SEQ ID NO: 697 - DNA, 19 bp, Artificial Sequence
  Description of Artificial Sequence: Chemically synthesized oligonucleotide
aggaccaggagccagtggc

SEQ ID NO: 698 - DNA, 19 bp, Artificial Sequence
  Description of Artificial Sequence: Chemically synthesized oligonucleotide
gccactggctcctggtcct

SEQ ID NO: 699 - DNA, 19 bp, Artificial Sequence
  Description of Artificial Sequence: Chemically synthesized oligonucleotide
ggaccaggagccagtggcc

SEQ ID NO: 700 - DNA, 19 bp, Artificial Sequence
  Description of Artificial Sequence: Chemically synthesized oligonucleotide
ggccactggctcctggtcc

SEQ ID NO: 701 - DNA, 19 bp, Artificial Sequence
  Description of Artificial Sequence: Chemically synthesized oligonucleotide
gaccaggagccagtggccc

SEQ ID NO: 702 - DNA, 19 bp, Artificial Sequence
  Description of Artificial Sequence: Chemically synthesized oligonucleotide
gggccactggctcctggtc

SEQ ID NO: 703 - DNA, 19 bp, Artificial Sequence
  Description of Artificial Sequence: Chemically synthesized oligonucleotide
accaggagccagtggcccg

SEQ ID NO: 704 - DNA, 19 bp, Artificial Sequence
  Description of Artificial Sequence: Chemically synthesized oligonucleotide
cgggccactggctcctggt

SEQ ID NO: 705 - DNA, 19 bp, Artificial Sequence
  Description of Artificial Sequence: Chemically synthesized oligonucleotide
ccaggagccagtggcccgg

SEQ ID NO: 706 - DNA, 19 bp, Artificial Sequence
  Description of Artificial Sequence: Chemically synthesized oligonucleotide
ccgggccactggctcctgg

SEQ ID NO: 707 - DNA, 19 bp, Artificial Sequence
  Description of Artificial Sequence: Chemically synthesized oligonucleotide
caggagccagtggcccggc

SEQ ID NO: 708 - DNA, 19 bp, Artificial Sequence
  Description of Artificial Sequence: Chemically synthesized oligonucleotide
gccgggccactggctcctg

SEQ ID NO: 709 - DNA, 19 bp, Artificial Sequence
  Description of Artificial Sequence: Chemically synthesized oligonucleotide
aggagccagtggcccggca

SEQ ID NO: 710 - DNA, 19 bp, Artificial Sequence
  Description of Artificial Sequence: Chemically synthesized oligonucleotide
tgccgggccactggctcct

SEQ ID NO: 711 - DNA, 19 bp, Artificial Sequence
  Description of Artificial Sequence: Chemically synthesized oligonucleotide
ggagccagtggcccggcag

SEQ ID NO: 712 - DNA, 19 bp, Artificial Sequence
  Description of Artificial Sequence: Chemically synthesized oligonucleotide
ctgccgggccactggctcc

SEQ ID NO: 713 - DNA, 19 bp, Artificial Sequence
  Description of Artificial Sequence: Chemically synthesized oligonucleotide
gagccagtggcccggcagg

SEQ ID NO: 714 - DNA, 19 bp, Artificial Sequence
  Description of Artificial Sequence: Chemically synthesized oligonucleotide
cctgccgggccactggctc

SEQ ID NO: 715 - DNA, 19 bp, Artificial Sequence
  Description of Artificial Sequence: Chemically synthesized oligonucleotide
agccagtggcccggcaggc

SEQ ID NO: 716 - DNA, 19 bp, Artificial Sequence
  Description of Artificial Sequence: Chemically synthesized oligonucleotide
gcctgccgggccactggct

SEQ ID NO: 717 - DNA, 19 bp, Artificial Sequence
  Description of Artificial Sequence: Chemically synthesized oligonucleotide
gccagtggcccggcaggca

SEQ ID NO: 718 - DNA, 19 bp, Artificial Sequence
  Description of Artificial Sequence: Chemically synthesized oligonucleotide
tgcctgccgggccactggc

SEQ ID NO: 719 - DNA, 19 bp, Artificial Sequence
  Description of Artificial Sequence: Chemically synthesized oligonucleotide
ccagtggcccggcaggcac

SEQ ID NO: 720 - DNA, 19 bp, Artificial Sequence
  Description of Artificial Sequence: Chemically synthesized oligonucleotide
gtgcctgccgggccactgg

SEQ ID NO: 721 - DNA, 19 bp, Artificial Sequence
  Description of Artificial Sequence: Chemically synthesized oligonucleotide
cagtggcccggcaggcaca

SEQ ID NO: 722 - DNA, 19 bp, Artificial Sequence
  Description of Artificial Sequence: Chemically synthesized oligonucleotide
tgtgcctgccgggccactg

SEQ ID NO: 723 - DNA, 19 bp, Artificial Sequence
  Description of Artificial Sequence: Chemically synthesized oligonucleotide
agtggcccggcaggcacag

SEQ ID NO: 724 - DNA, 19 bp, Artificial Sequence
  Description of Artificial Sequence: Chemically synthesized oligonucleotide
ctgtgcctgccgggccact

SEQ ID NO: 725 - DNA, 19 bp, Artificial Sequence
  Description of Artificial Sequence: Chemically synthesized oligonucleotide
gtggcccggcaggcacagc

SEQ ID NO: 726 - DNA, 19 bp, Artificial Sequence
  Description of Artificial Sequence: Chemically synthesized oligonucleotide
gctgtgcctgccgggccac

SEQ ID NO: 727 - DNA, 19 bp, Artificial Sequence
  Description of Artificial Sequence: Chemically synthesized oligonucleotide
tggcccggcaggcacagcc

SEQ ID NO: 728 - DNA, 19 bp, Artificial Sequence
  Description of Artificial Sequence: Chemically synthesized oligonucleotide
ggctgtgcctgccgggcca

SEQ ID NO: 729 - DNA, 19 bp, Artificial Sequence
  Description of Artificial Sequence: Chemically synthesized oligonucleotide
ggcccggcaggcacagccc

SEQ ID NO: 730 - DNA, 19 bp, Artificial Sequence
  Description of Artificial Sequence: Chemically synthesized oligonucleotide
gggctgtgcctgccgggcc

SEQ ID NO: 731 - DNA, 19 bp, Artificial Sequence
  Description of Artificial Sequence: Chemically synthesized oligonucleotide
gcccggcaggcacagcccg

SEQ ID NO: 732 - DNA, 19 bp, Artificial Sequence
  Description of Artificial Sequence: Chemically synthesized oligonucleotide
cgggctgtgcctgccgggc

SEQ ID NO: 733 - DNA, 19 bp, Artificial Sequence
  Description of Artificial Sequence: Chemically synthesized oligonucleotide
cccggcaggcacagcccgg

SEQ ID NO: 734 - DNA, 19 bp, Artificial Sequence
  Description of Artificial Sequence: Chemically synthesized oligonucleotide
ccgggctgtgcctgccggg

SEQ ID NO: 735 - DNA, 19 bp, Artificial Sequence
  Description of Artificial Sequence: Chemically synthesized oligonucleotide
ccggcaggcacagcccggt

SEQ ID NO: 736 - DNA, 19 bp, Artificial Sequence
  Description of Artificial Sequence: Chemically synthesized oligonucleotide
accgggctgtgcctgccgg

SEQ ID NO: 737 - DNA, 19 bp, Artificial Sequence
  Description of Artificial Sequence: Chemically synthesized oligonucleotide
cggcaggcacagcccggtt

SEQ ID NO: 738 - DNA, 19 bp, Artificial Sequence
  Description of Artificial Sequence: Chemically synthesized oligonucleotide
aaccgggctgtgcctgccg

SEQ ID NO: 739 - DNA, 19 bp, Artificial Sequence
  Description of Artificial Sequence: Chemically synthesized oligonucleotide
ggcaggcacagcccggttg

SEQ ID NO: 740 - DNA, 19 bp, Artificial Sequence
  Description of Artificial Sequence: Chemically synthesized oligonucleotide
caaccgggctgtgcctgcc

SEQ ID NO: 741 - DNA, 19 bp, Artificial Sequence
  Description of Artificial Sequence: Chemically synthesized oligonucleotide
gcaggcacagcccggttgg

SEQ ID NO: 742 - DNA, 19 bp, Artificial Sequence
  Description of Artificial Sequence: Chemically synthesized oligonucleotide
ccaaccgggctgtgcctgc

SEQ ID NO: 743 - DNA, 19 bp, Artificial Sequence
  Description of Artificial Sequence: Chemically synthesized oligonucleotide
caggcacagcccggttggc

SEQ ID NO: 744 - DNA, 19 bp, Artificial Sequence
  Description of Artificial Sequence: Chemically synthesized oligonucleotide
gccaaccgggctgtgcctg

SEQ ID NO: 745 - DNA, 19 bp, Artificial Sequence
  Description of Artificial Sequence: Chemically synthesized oligonucleotide
aggcacagcccggttggcg

SEQ ID NO: 746 - DNA, 19 bp, Artificial Sequence
  Description of Artificial Sequence: Chemically synthesized oligonucleotide
cgccaaccgggctgtgcct

SEQ ID NO: 747 - DNA, 19 bp, Artificial Sequence
  Description of Artificial Sequence: Chemically synthesized oligonucleotide
ggcacagcccggttggcgt

SEQ ID NO: 748 - DNA, 19 bp, Artificial Sequence
  Description of Artificial Sequence: Chemically synthesized oligonucleotide
acgccaaccgggctgtgcc

SEQ ID NO: 749 - DNA, 19 bp, Artificial Sequence
  Description of Artificial Sequence: Chemically synthesized oligonucleotide
gcacagcccggttggcgtg

SEQ ID NO: 750 - DNA, 19 bp, Artificial Sequence
  Description of Artificial Sequence: Chemically synthesized oligonucleotide
cacgccaaccgggctgtgc

SEQ ID NO: 751 - DNA, 19 bp, Artificial Sequence
  Description of Artificial Sequence: Chemically synthesized oligonucleotide
cacagcccggttggcgtgg

SEQ ID NO: 752 - DNA, 19 bp, Artificial Sequence
  Description of Artificial Sequence: Chemically synthesized oligonucleotide
ccacgccaaccgggctgtg

SEQ ID NO: 753 - DNA, 19 bp, Artificial Sequence
  Description of Artificial Sequence: Chemically synthesized oligonucleotide
acagcccggttggcgtggg

SEQ ID NO: 754 - DNA, 19 bp, Artificial Sequence
  Description of Artificial Sequence: Chemically synthesized oligonucleotide
cccacgccaaccgggctgt

SEQ ID NO: 755 - DNA, 19 bp, Artificial Sequence
  Description of Artificial Sequence: Chemically synthesized oligonucleotide
cagcccggttggcgtgggc

SEQ ID NO: 756 - DNA, 19 bp, Artificial Sequence
  Description of Artificial Sequence: Chemically synthesized oligonucleotide
gcccacgccaaccgggctg

SEQ ID NO: 757 - DNA, 19 bp, Artificial Sequence
  Description of Artificial Sequence: Chemically synthesized oligonucleotide
agcccggttggcgtgggcc

SEQ ID NO: 758 - DNA, 19 bp, Artificial Sequence
  Description of Artificial Sequence: Chemically synthesized oligonucleotide
ggcccacgccaaccgggct

SEQ ID NO: 759 - DNA, 19 bp, Artificial Sequence
  Description of Artificial Sequence: Chemically synthesized oligonucleotide
gcccggttggcgtgggcca

SEQ ID NO: 760 - DNA, 19 bp, Artificial Sequence
  Description of Artificial Sequence: Chemically synthesized oligonucleotide
tggcccacgccaaccgggc

SEQ ID NO: 761 - DNA, 19 bp, Artificial Sequence
  Description of Artificial Sequence: Chemically synthesized oligonucleotide
cccggttggcgtgggccag

SEQ ID NO: 762 - DNA, 19 bp, Artificial Sequence
  Description of Artificial Sequence: Chemically synthesized oligonucleotide
ctggcccacgccaaccggg

SEQ ID NO: 763 - DNA, 19 bp, Artificial Sequence
  Description of Artificial Sequence: Chemically synthesized oligonucleotide
ccggttggcgtgggccaga

SEQ ID NO: 764 - DNA, 19 bp, Artificial Sequence
  Description of Artificial Sequence: Chemically synthesized oligonucleotide
tctggcccacgccaaccgg

SEQ ID NO: 765 - DNA, 19 bp, Artificial Sequence
  Description of Artificial Sequence: Chemically synthesized oligonucleotide
cggttggcgtgggccagag

SEQ ID NO: 766 - DNA, 19 bp, Artificial Sequence
  Description of Artificial Sequence: Chemically synthesized oligonucleotide
ctctggcccacgccaaccg

SEQ ID NO: 767 - DNA, 19 bp, Artificial Sequence
  Description of Artificial Sequence: Chemically synthesized oligonucleotide
ggttggcgtgggccagagc

SEQ ID NO: 768 - DNA, 19 bp, Artificial Sequence
  Description of Artificial Sequence: Chemically synthesized oligonucleotide
gctctggcccacgccaacc

SEQ ID NO: 769 - DNA, 19 bp, Artificial Sequence
  Description of Artificial Sequence: Chemically synthesized oligonucleotide
gttggcgtgggccagagcg

SEQ ID NO: 770 - DNA, 19 bp, Artificial Sequence
  Description of Artificial Sequence: Chemically synthesized oligonucleotide
cgctctggcccacgccaac

SEQ ID NO: 771 - DNA, 19 bp, Artificial Sequence
  Description of Artificial Sequence: Chemically synthesized oligonucleotide
ttggcgtgggccagagcgc

SEQ ID NO: 772 - DNA, 19 bp, Artificial Sequence
  Description of Artificial Sequence: Chemically synthesized oligonucleotide
gcgctctggcccacgccaa

SEQ ID NO: 773 - DNA, 19 bp, Artificial Sequence
  Description of Artificial Sequence: Chemically synthesized oligonucleotide
tggcgtgggccagagcgcc

SEQ ID NO: 774 - DNA, 19 bp, Artificial Sequence
  Description of Artificial Sequence: Chemically synthesized oligonucleotide
ggcgctctggcccacgcca

SEQ ID NO: 775 - DNA, 19 bp, Artificial Sequence
  Description of Artificial Sequence: Chemically synthesized oligonucleotide
ggcgtgggccagagcgccc

SEQ ID NO: 776 - DNA, 19 bp, Artificial Sequence
  Description of Artificial Sequence: Chemically synthesized oligonucleotide
gggcgctctggcccacgcc

SEQ ID NO: 777 - DNA, 19 bp, Artificial Sequence
  Description of Artificial Sequence: Chemically synthesized oligonucleotide
gcgtgggccagagcgccca

SEQ ID NO: 778 - DNA, 19 bp, Artificial Sequence
  Description of Artificial Sequence: Chemically synthesized oligonucleotide
tgggcgctctggcccacgc

SEQ ID NO: 779 - DNA, 19 bp, Artificial Sequence
  Description of Artificial Sequence: Chemically synthesized oligonucleotide
cgtgggccagagcgcccat

SEQ ID NO: 780 - DNA, 19 bp, Artificial Sequence
  Description of Artificial Sequence: Chemically synthesized oligonucleotide
atgggcgctctggcccacg

SEQ ID NO: 781 - DNA, 19 bp, Artificial Sequence
  Description of Artificial Sequence: Chemically synthesized oligonucleotide
gtgggccagagcgcccatc

SEQ ID NO: 782 - DNA, 19 bp, Artificial Sequence
  Description of Artificial Sequence: Chemically synthesized oligonucleotide
gatgggcgctctggcccac

SEQ ID NO: 783 - DNA, 19 bp, Artificial Sequence
  Description of Artificial Sequence: Chemically synthesized oligonucleotide
tgggccagagcgcccatca

SEQ ID NO: 784 - DNA, 19 bp, Artificial Sequence
  Description of Artificial Sequence: Chemically synthesized oligonucleotide
tgatgggcgctctggccca

SEQ ID NO: 785 - DNA, 19 bp, Artificial Sequence
  Description of Artificial Sequence: Chemically synthesized oligonucleotide
gggccagagcgcccatcac

SEQ ID NO: 786 - DNA, 19 bp, Artificial Sequence
  Description of Artificial Sequence: Chemically synthesized oligonucleotide
gtgatgggcgctctggccc

SEQ ID NO: 787 - DNA, 19 bp, Artificial Sequence
  Description of Artificial Sequence: Chemically synthesized oligonucleotide
ggccagagcgcccatcact

SEQ ID NO: 788 - DNA, 19 bp, Artificial Sequence
  Description of Artificial Sequence: Chemically synthesized oligonucleotide
agtgatgggcgctctggcc

SEQ ID NO: 789 - DNA, 19 bp, Artificial Sequence
  Description of Artificial Sequence: Chemically synthesized oligonucleotide
gccagagcgcccatcactg

SEQ ID NO: 790 - DNA, 19 bp, Artificial Sequence
  Description of Artificial Sequence: Chemically synthesized oligonucleotide
cagtgatgggcgctctggc

SEQ ID NO: 791 - DNA, 19 bp, Artificial Sequence
  Description of Artificial Sequence: Chemically synthesized oligonucleotide
ccagagcgcccatcactga

SEQ ID NO: 792 - DNA, 19 bp, Artificial Sequence
  Description of Artificial Sequence: Chemically synthesized oligonucleotide
tcagtgatgggcgctctgg

SEQ ID NO: 793 - DNA, 19 bp, Artificial Sequence
  Description of Artificial Sequence: Chemically synthesized oligonucleotide
cagagcgcccatcactgac

SEQ ID NO: 794 - DNA, 19 bp, Artificial Sequence
  Description of Artificial Sequence: Chemically synthesized oligonucleotide
gtcagtgatgggcgctctg

SEQ ID NO: 795 - DNA, 19 bp, Artificial Sequence
  Description of Artificial Sequence: Chemically synthesized oligonucleotide
agagcgcccatcactgacc

SEQ ID NO: 796 - DNA, 19 bp, Artificial Sequence
  Description of Artificial Sequence: Chemically synthesized oligonucleotide
ggtcagtgatgggcgctct

SEQ ID NO: 797 - DNA, 19 bp, Artificial Sequence
  Description of Artificial Sequence: Chemically synthesized oligonucleotide
gagcgcccatcactgaccc

SEQ ID NO: 798 - DNA, 19 bp, Artificial Sequence
  Description of Artificial Sequence: Chemically synthesized oligonucleotide
gggtcagtgatgggcgctc

SEQ ID NO: 799 - DNA, 19 bp, Artificial Sequence
  Description of Artificial Sequence: Chemically synthesized oligonucleotide
agcgcccatcactgacccg

SEQ ID NO: 800 - DNA, 19 bp, Artificial Sequence
  Description of Artificial Sequence: Chemically synthesized oligonucleotide
cgggtcagtgatgggcgct

SEQ ID NO: 801 - DNA, 19 bp, Artificial Sequence
  Description of Artificial Sequence: Chemically synthesized oligonucleotide
gcgcccatcactgacccgt

SEQ ID NO: 802 - DNA, 19 bp, Artificial Sequence
  Description of Artificial Sequence: Chemically synthesized oligonucleotide
acgggtcagtgatgggcgc

SEQ ID NO: 803 - DNA, 19 bp, Artificial Sequence
  Description of Artificial Sequence: Chemically synthesized oligonucleotide
cgcccatcactgacccgtg

SEQ ID NO: 804 - DNA, 19 bp, Artificial Sequence
  Description of Artificial Sequence: Chemically synthesized oligonucleotide
cacgggtcagtgatgggcg

SEQ ID NO: 805 - DNA, 19 bp, Artificial Sequence
  Description of Artificial Sequence: Chemically synthesized oligonucleotide
gcccatcactgacccgtga

SEQ ID NO: 806 - DNA, 19 bp, Artificial Sequence
  Description of Artificial Sequence: Chemically synthesized oligonucleotide
tcacgggtcagtgatgggc

SEQ ID NO: 807 - DNA, 19 bp, Artificial Sequence
  Description of Artificial Sequence: Chemically synthesized oligonucleotide
cccatcactgacccgtgag

SEQ ID NO: 808 - DNA, 19 bp, Artificial Sequence
  Description of Artificial Sequence: Chemically synthesized oligonucleotide
ctcacgggtcagtgatggg

SEQ ID NO: 809 - DNA, 19 bp, Artificial Sequence
  Description of Artificial Sequence: Chemically synthesized oligonucleotide
ccatcactgacccgtgaga

SEQ ID NO: 810 - DNA, 19 bp, Artificial Sequence
  Description of Artificial Sequence: Chemically synthesized oligonucleotide
tctcacgggtcagtgatgg

SEQ ID NO: 811 - DNA, 19 bp, Artificial Sequence
  Description of Artificial Sequence: Chemically synthesized oligonucleotide
catcactgacccgtgagaa

SEQ ID NO: 812 - DNA, 19 bp, Artificial Sequence
  Description of Artificial Sequence: Chemically synthesized oligonucleotide
ttctcacgggtcagtgatg

SEQ ID NO: 813 - DNA, 19 bp, Artificial Sequence
  Description of Artificial Sequence: Chemically synthesized oligonucleotide
atcactgacccgtgagaac

SEQ ID NO: 814 - DNA, 19 bp, Artificial Sequence
  Description of Artificial Sequence: Chemically synthesized oligonucleotide
gttctcacgggtcagtgat

SEQ ID NO: 815 - DNA, 19 bp, Artificial Sequence
  Description of Artificial Sequence: Chemically synthesized oligonucleotide
tcactgacccgtgagaact

SEQ ID NO: 816 - DNA, 19 bp, Artificial Sequence
  Description of Artificial Sequence: Chemically synthesized oligonucleotide
agttctcacgggtcagtga

SEQ ID NO: 817 - DNA, 19 bp, Artificial Sequence
  Description of Artificial Sequence: Chemically synthesized oligonucleotide
cactgacccgtgagaactc

SEQ ID NO: 818 - DNA, 19 bp, Artificial Sequence
  Description of Artificial Sequence: Chemically synthesized oligonucleotide
gagttctcacgggtcagtg

SEQ ID NO: 819 - DNA, 19 bp, Artificial Sequence
  Description of Artificial Sequence: Chemically synthesized oligonucleotide
actgacccgtgagaactcg

SEQ ID NO: 820 - DNA, 19 bp, Artificial Sequence
  Description of Artificial Sequence: Chemically synthesized oligonucleotide
cgagttctcacgggtcagt

SEQ ID NO: 821 - DNA, 19 bp, Artificial Sequence
  Description of Artificial Sequence: Chemically synthesized oligonucleotide
ctgacccgtgagaactcga

SEQ ID NO: 822 - DNA, 19 bp, Artificial Sequence
  Description of Artificial Sequence: Chemically synthesized oligonucleotide
tcgagttctcacgggtcag

SEQ ID NO: 823 - DNA, 19 bp, Artificial Sequence
  Description of Artificial Sequence: Chemically synthesized oligonucleotide
tgacccgtgagaactcgac

SEQ ID NO: 824 - DNA, 19 bp, Artificial Sequence
  Description of Artificial Sequence: Chemically synthesized oligonucleotide
gtcgagttctcacgggtca

SEQ ID NO: 825 - DNA, 19 bp, Artificial Sequence
  Description of Artificial Sequence: Chemically synthesized oligonucleotide
gacccgtgagaactcgact

SEQ ID NO: 826 - DNA, 19 bp, Artificial Sequence
  Description of Artificial Sequence: Chemically synthesized oligonucleotide
agtcgagttctcacgggtc

SEQ ID NO: 827 - DNA, 19 bp, Artificial Sequence
  Description of Artificial Sequence: Chemically synthesized oligonucleotide
acccgtgagaactcgactg

SEQ ID NO: 828 - DNA, 19 bp, Artificial Sequence
  Description of Artificial Sequence: Chemically synthesized oligonucleotide
cagtcgagttctcacgggt

SEQ ID NO: 829 - DNA, 19 bp, Artificial Sequence
  Description of Artificial Sequence: Chemically synthesized oligonucleotide
cccgtgagaactcgactgc

SEQ ID NO: 830 - DNA, 19 bp, Artificial Sequence
  Description of Artificial Sequence: Chemically synthesized oligonucleotide
gcagtcgagttctcacggg

SEQ ID NO: 831 - DNA, 19 bp, Artificial Sequence
  Description of Artificial Sequence: Chemically synthesized oligonucleotide
ccgtgagaactcgactgcc

SEQ ID NO: 832 - DNA, 19 bp, Artificial Sequence
  Description of Artificial Sequence: Chemically synthesized oligonucleotide
ggcagtcgagttctcacgg

SEQ ID NO: 833 - DNA, 19 bp, Artificial Sequence
  Description of Artificial Sequence: Chemically synthesized oligonucleotide
cgtgagaactcgactgccc

SEQ ID NO: 834 - DNA, 19 bp, Artificial Sequence
  Description of Artificial Sequence: Chemically synthesized oligonucleotide
gggcagtcgagttctcacg

SEQ ID NO: 835 - DNA, 19 bp, Artificial Sequence
  Description of Artificial Sequence: Chemically synthesized oligonucleotide
gtgagaactcgactgcccc

SEQ ID NO: 836 - DNA, 19 bp, Artificial Sequence
  Description of Artificial Sequence: Chemically synthesized oligonucleotide
ggggcagtcgagttctcac

SEQ ID NO: 837 - DNA, 19 bp, Artificial Sequence
  Description of Artificial Sequence: Chemically synthesized oligonucleotide
tgagaactcgactgcccct

SEQ ID NO: 838 - DNA, 19 bp, Artificial Sequence
  Description of Artificial Sequence: Chemically synthesized oligonucleotide
aggggcagtcgagttctca

SEQ ID NO: 839 - DNA, 19 bp, Artificial Sequence
  Description of Artificial Sequence: Chemically synthesized oligonucleotide
gagaactcgactgcccctg

SEQ ID NO: 840 - DNA, 19 bp, Artificial Sequence
  Description of Artificial Sequence: Chemically synthesized oligonucleotide
caggggcagtcgagttctc

SEQ ID NO: 841 - DNA, 19 bp, Artificial Sequence
  Description of Artificial Sequence: Chemically synthesized oligonucleotide
agaactcgactgcccctgc

SEQ ID NO: 842 - DNA, 19 bp, Artificial Sequence
  Description of Artificial Sequence: Chemically synthesized oligonucleotide
gcaggggcagtcgagttct

SEQ ID NO: 843 - DNA, 19 bp, Artificial Sequence
  Description of Artificial Sequence: Chemically synthesized oligonucleotide
gaactcgactgcccctgcc

SEQ ID NO: 844 - DNA, 19 bp, Artificial Sequence
  Description of Artificial Sequence: Chemically synthesized oligonucleotide
ggcaggggcagtcgagttc

SEQ ID NO: 845 - DNA, 19 bp, Artificial Sequence
  Description of Artificial Sequence: Chemically synthesized oligonucleotide
aactcgactgcccctgcca

SEQ ID NO: 846 - DNA, 19 bp, Artificial Sequence
  Description of Artificial Sequence: Chemically synthesized oligonucleotide
tggcaggggcagtcgagtt

SEQ ID NO: 847 - DNA, 19 bp, Artificial Sequence
  Description of Artificial Sequence: Chemically synthesized oligonucleotide
actcgactgcccctgccag

SEQ ID NO: 848 - DNA, 19 bp, Artificial Sequence
  Description of Artificial Sequence: Chemically synthesized oligonucleotide
ctggcaggggcagtcgagt

SEQ ID NO: 849 - DNA, 19 bp, Artificial Sequence
  Description of Artificial Sequence: Chemically synthesized oligonucleotide
ctcgactgcccctgccagc

SEQ ID NO: 850 - DNA, 19 bp, Artificial Sequence
  Description of Artificial Sequence: Chemically synthesized oligonucleotide
gctggcaggggcagtcgag

SEQ ID NO: 851 - DNA, 19 bp, Artificial Sequence
  Description of Artificial Sequence: Chemically synthesized oligonucleotide
tcgactgcccctgccagct

SEQ ID NO: 852 - DNA, 19 bp, Artificial Sequence
  Description of Artificial Sequence: Chemically synthesized oligonucleotide
agctggcaggggcagtcga

SEQ ID NO: 853 - DNA, 19 bp, Artificial Sequence
  Description of Artificial Sequence: Chemically synthesized oligonucleotide
cgactgcccctgccagctc

SEQ ID NO: 854 - DNA, 19 bp, Artificial Sequence
  Description of Artificial Sequence: Chemically synthesized oligonucleotide
gagctggcaggggcagtcg

SEQ ID NO: 855 - DNA, 19 bp, Artificial Sequence
  Description of Artificial Sequence: Chemically synthesized oligonucleotide
gactgcccctgccagctct

SEQ ID NO: 856 - DNA, 19 bp, Artificial Sequence
  Description of Artificial Sequence: Chemically synthesized oligonucleotide
agagctggcaggggcagtc

SEQ ID NO: 857 - DNA, 19 bp, Artificial Sequence
  Description of Artificial Sequence: Chemically synthesized oligonucleotide
actgcccctgccagctctg

SEQ ID NO: 858 - DNA, 19 bp, Artificial Sequence
  Description of Artificial Sequence: Chemically synthesized oligonucleotide
cagagctggcaggggcagt

SEQ ID NO: 859 - DNA, 19 bp, Artificial Sequence
  Description of Artificial Sequence: Chemically synthesized oligonucleotide
ctgcccctgccagctctgg

SEQ ID NO: 860 - DNA, 19 bp, Artificial Sequence
  Description of Artificial Sequence: Chemically synthesized oligonucleotide
ccagagctggcaggggcag

SEQ ID NO: 861 - DNA, 19 bp, Artificial Sequence
  Description of Artificial Sequence: Chemically synthesized oligonucleotide
tgcccctgccagctctggc

SEQ ID NO: 862 - DNA, 19 bp, Artificial Sequence
  Description of Artificial Sequence: Chemically synthesized oligonucleotide
gccagagctggcaggggca

SEQ ID NO: 863 - DNA, 19 bp, Artificial Sequence
  Description of Artificial Sequence: Chemically synthesized oligonucleotide
gcccctgccagctctggca

SEQ ID NO: 864 - DNA, 19 bp, Artificial Sequence
  Description of Artificial Sequence: Chemically synthesized oligonucleotide
tgccagagctggcaggggc

SEQ ID NO: 865 - DNA, 19 bp, Artificial Sequence
  Description of Artificial Sequence: Chemically synthesized oligonucleotide
cccctgccagctctggcac

SEQ ID NO: 866 - DNA, 19 bp, Artificial Sequence
  Description of Artificial Sequence: Chemically synthesized oligonucleotide
gtgccagagctggcagggg

SEQ ID NO: 867 - DNA, 19 bp, Artificial Sequence
  Description of Artificial Sequence: Chemically synthesized oligonucleotide
ccctgccagctctggcact

SEQ ID NO: 868 - DNA, 19 bp, Artificial Sequence
  Description of Artificial Sequence: Chemically synthesized oligonucleotide
agtgccagagctggcaggg

SEQ ID NO: 869 - DNA, 19 bp, Artificial Sequence
  Description of Artificial Sequence: Chemically synthesized oligonucleotide
cctgccagctctggcactg

SEQ ID NO: 870 - DNA, 19 bp, Artificial Sequence
  Description of Artificial Sequence: Chemically synthesized oligonucleotide
cagtgccagagctggcagg

SEQ ID NO: 871 - DNA, 19 bp, Artificial Sequence
  Description of Artificial Sequence: Chemically synthesized oligonucleotide
ctgccagctctggcactgc

SEQ ID NO: 872 - DNA, 19 bp, Artificial Sequence
  Description of Artificial Sequence: Chemically synthesized oligonucleotide
gcagtgccagagctggcag

SEQ ID NO: 873 - DNA, 19 bp, Artificial Sequence
  Description of Artificial Sequence: Chemically synthesized oligonucleotide
tgccagctctggcactgcc

SEQ ID NO: 874 - DNA, 19 bp, Artificial Sequence
  Description of Artificial Sequence: Chemically synthesized oligonucleotide
ggcagtgccagagctggca

SEQ ID NO: 875 - DNA, 19 bp, Artificial Sequence
  Description of Artificial Sequence: Chemically synthesized oligonucleotide
gccagctctggcactgccc

SEQ ID NO: 876 - DNA, 19 bp, Artificial Sequence
  Description of Artificial Sequence: Chemically synthesized oligonucleotide
gggcagtgccagagctggc

SEQ ID NO: 877 - DNA, 19 bp, Artificial Sequence
  Description of Artificial Sequence: Chemically synthesized oligonucleotide
ccagctctggcactgcccc

SEQ ID NO: 878 - DNA, 19 bp, Artificial Sequence
  Description of Artificial Sequence: Chemically synthesized oligonucleotide
ggggcagtgccagagctgg

SEQ ID NO: 879 - DNA, 19 bp, Artificial Sequence
  Description of Artificial Sequence: Chemically synthesized oligonucleotide
cagctctggcactgccccc

SEQ ID NO: 880 - DNA, 19 bp, Artificial Sequence
  Description of Artificial Sequence: Chemically synthesized oligonucleotide
gggggcagtgccagagctg

SEQ ID NO: 881 - DNA, 19 bp, Artificial Sequence
  Description of Artificial Sequence: Chemically synthesized oligonucleotide
agctctggcactgccccct

SEQ ID NO: 882 - DNA, 19 bp, Artificial Sequence
  Description of Artificial Sequence: Chemically synthesized oligonucleotide
agggggcagtgccagagct

SEQ ID NO: 883 - DNA, 19 bp, Artificial Sequence
  Description of Artificial Sequence: Chemically synthesized oligonucleotide
gctctggcactgccccctc

SEQ ID NO: 884 - DNA, 19 bp, Artificial Sequence
  Description of Artificial Sequence: Chemically synthesized oligonucleotide
gagggggcagtgccagagc

SEQ ID NO: 885 - DNA, 19 bp, Artificial Sequence
  Description of Artificial Sequence: Chemically synthesized oligonucleotide
ctctggcactgccccctcc

SEQ ID NO: 886 - DNA, 19 bp, Artificial Sequence
  Description of Artificial Sequence: Chemically synthesized oligonucleotide
ggagggggcagtgccagag

SEQ ID NO: 887 - DNA, 19 bp, Artificial Sequence
  Description of Artificial Sequence: Chemically synthesized oligonucleotide
tctggcactgccccctccc

SEQ ID NO: 888 - DNA, 19 bp, Artificial Sequence
  Description of Artificial Sequence: Chemically synthesized oligonucleotide
gggagggggcagtgccaga

SEQ ID NO: 889 - DNA, 19 bp, Artificial Sequence
  Description of Artificial Sequence: Chemically synthesized oligonucleotide
ctggcactgccccctccca

SEQ ID NO: 890 - DNA, 19 bp, Artificial Sequence
  Description of Artificial Sequence: Chemically synthesized oligonucleotide
tgggagggggcagtgccag

SEQ ID NO: 891 - DNA, 19 bp, Artificial Sequence
  Description of Artificial Sequence: Chemically synthesized oligonucleotide
tggcactgccccctcccag

SEQ ID NO: 892 - DNA, 19 bp, Artificial Sequence
  Description of Artificial Sequence: Chemically synthesized oligonucleotide
ctgggagggggcagtgcca

SEQ ID NO: 893 - DNA, 19 bp, Artificial Sequence
  Description of Artificial Sequence: Chemically synthesized oligonucleotide
ggcactgccccctcccagc

SEQ ID NO: 894 - DNA, 19 bp, Artificial Sequence
  Description of Artificial Sequence: Chemically synthesized oligonucleotide
gctgggagggggcagtgcc

SEQ ID NO: 895 - DNA, 19 bp, Artificial Sequence
  Description of Artificial Sequence: Chemically synthesized oligonucleotide
gcactgccccctcccagcc

SEQ ID NO: 896 - DNA, 19 bp, Artificial Sequence
  Description of Artificial Sequence: Chemically synthesized oligonucleotide
ggctgggagggggcagtgc

SEQ ID NO: 897 - DNA, 19 bp, Artificial Sequence
  Description of Artificial Sequence: Chemically synthesized oligonucleotide
cactgccccctcccagccg

SEQ ID NO: 898 - DNA, 19 bp, Artificial Sequence
  Description of Artificial Sequence: Chemically synthesized oligonucleotide
cggctgggagggggcagtg

SEQ ID NO: 899 - DNA, 19 bp, Artificial Sequence
  Description of Artificial Sequence: Chemically synthesized oligonucleotide
actgccccctcccagccgc

SEQ ID NO: 900 - DNA, 19 bp, Artificial Sequence
  Description of Artificial Sequence: Chemically synthesized oligonucleotide
gcggctgggagggggcagt

SEQ ID NO: 901 - DNA, 19 bp, Artificial Sequence
  Description of Artificial Sequence: Chemically synthesized oligonucleotide
ctgccccctcccagccgcc

SEQ ID NO: 902 - DNA, 19 bp, Artificial Sequence
  Description of Artificial Sequence: Chemically synthesized oligonucleotide
ggcggctgggagggggcag

SEQ ID NO: 903 - DNA, 19 bp, Artificial Sequence
  Description of Artificial Sequence: Chemically synthesized oligonucleotide
tgccccctcccagccgccc

SEQ ID NO: 904 - DNA, 19 bp, Artificial Sequence
  Description of Artificial Sequence: Chemically synthesized oligonucleotide
gggcggctgggagggggca

SEQ ID NO: 905 - DNA, 19 bp, Artificial Sequence
  Description of Artificial Sequence: Chemically synthesized oligonucleotide
gccccctcccagccgcccc

SEQ ID NO: 906 - DNA, 19 bp, Artificial Sequence
  Description of Artificial Sequence: Chemically synthesized oligonucleotide
ggggcggctgggagggggc

SEQ ID NO: 907 - DNA, 19 bp, Artificial Sequence
  Description of Artificial Sequence: Chemically synthesized oligonucleotide
ccccctcccagccgccccg

SEQ ID NO: 908 - DNA, 19 bp, Artificial Sequence
  Description of Artificial Sequence: Chemically synthesized oligonucleotide
cggggcggctgggaggggg

SEQ ID NO: 909 - DNA, 19 bp, Artificial Sequence
  Description of Artificial Sequence: Chemically synthesized oligonucleotide
cccctcccagccgccccgc

SEQ ID NO: 910 - DNA, 19 bp, Artificial Sequence
  Description of Artificial Sequence: Chemically synthesized oligonucleotide
gcggggcggctgggagggg

SEQ ID NO: 911 - DNA, 19 bp, Artificial Sequence
  Description of Artificial Sequence: Chemically synthesized oligonucleotide
ccctcccagccgccccgcc

SEQ ID NO: 912 - DNA, 19 bp, Artificial Sequence
  Description of Artificial Sequence: Chemically synthesized oligonucleotide
ggcggggcggctgggaggg

SEQ ID NO: 913 - DNA, 19 bp, Artificial Sequence
  Description of Artificial Sequence: Chemically synthesized oligonucleotide
cctcccagccgccccgccc

SEQ ID NO: 914 - DNA, 19 bp, Artificial Sequence
  Description of Artificial Sequence: Chemically synthesized oligonucleotide
gggcggggcggctgggagg

SEQ ID NO: 915 - DNA, 19 bp, Artificial Sequence
  Description of Artificial Sequence: Chemically synthesized oligonucleotide
ctcccagccgccccgccct

SEQ ID NO: 916 - DNA, 19 bp, Artificial Sequence
  Description of Artificial Sequence: Chemically synthesized oligonucleotide
agggcggggcggctgggag

SEQ ID NO: 917 - DNA, 19 bp, Artificial Sequence
  Description of Artificial Sequence: Chemically synthesized oligonucleotide
tcccagccgccccgcccta

SEQ ID NO: 918 - DNA, 19 bp, Artificial Sequence
  Description of Artificial Sequence: Chemically synthesized oligonucleotide
tagggcggggcggctggga

SEQ ID NO: 919 - DNA, 19 bp, Artificial Sequence
  Description of Artificial Sequence: Chemically synthesized oligonucleotide
cccagccgccccgccctag

SEQ ID NO: 920 - DNA, 19 bp, Artificial Sequence
  Description of Artificial Sequence: Chemically synthesized oligonucleotide
ctagggcggggcggctggg

SEQ ID NO: 921 - DNA, 19 bp, Artificial Sequence
  Description of Artificial Sequence: Chemically synthesized oligonucleotide
ccagccgccccgccctagc

SEQ ID NO: 922 - DNA, 19 bp, Artificial Sequence
  Description of Artificial Sequence: Chemically synthesized oligonucleotide
gctagggcggggcggctgg

SEQ ID NO: 923 - DNA, 19 bp, Artificial Sequence
  Description of Artificial Sequence: Chemically synthesized oligonucleotide
cagccgccccgccctagca

SEQ ID NO: 924 - DNA, 19 bp, Artificial Sequence
  Description of Artificial Sequence: Chemically synthesized oligonucleotide
tgctagggcggggcggctg

SEQ ID NO: 925 - DNA, 19 bp, Artificial Sequence
  Description of Artificial Sequence: Chemically synthesized oligonucleotide
agccgccccgccctagcac

SEQ ID NO: 926 - DNA, 19 bp, Artificial Sequence
  Description of Artificial Sequence: Chemically synthesized oligonucleotide
gtgctagggcggggcggct

SEQ ID NO: 927 - DNA, 19 bp, Artificial Sequence
  Description of Artificial Sequence: Chemically synthesized oligonucleotide
gccgccccgccctagcacc

SEQ ID NO: 928 - DNA, 19 bp, Artificial Sequence
  Description of Artificial Sequence: Chemically synthesized oligonucleotide
ggtgctagggcggggcggc

SEQ ID NO: 929 - DNA, 19 bp, Artificial Sequence
  Description of Artificial Sequence: Chemically synthesized oligonucleotide
ccgccccgccctagcaccc

SEQ ID NO: 930 - DNA, 19 bp, Artificial Sequence
  Description of Artificial Sequence: Chemically synthesized oligonucleotide
gggtgctagggcggggcgg

SEQ ID NO: 931 - DNA, 19 bp, Artificial Sequence
  Description of Artificial Sequence: Chemically synthesized oligonucleotide
cgccccgccctagcaccct

SEQ ID NO: 932 - DNA, 19 bp, Artificial Sequence
  Description of Artificial Sequence: Chemically synthesized oligonucleotide
agggtgctagggcggggcg

SEQ ID NO: 933 - DNA, 19 bp, Artificial Sequence
  Description of Artificial Sequence: Chemically synthesized oligonucleotide
gccccgccctagcaccctg

SEQ ID NO: 934 - DNA, 19 bp, Artificial Sequence
  Description of Artificial Sequence: Chemically synthesized oligonucleotide
cagggtgctagggcggggc

SEQ ID NO: 935 - DNA, 19 bp, Artificial Sequence
  Description of Artificial Sequence: Chemically synthesized oligonucleotide
ccccgccctagcaccctgg

SEQ ID NO: 936 - DNA, 19 bp, Artificial Sequence
  Description of Artificial Sequence: Chemically synthesized oligonucleotide
ccagggtgctagggcgggg

SEQ ID NO: 937 - DNA, 19 bp, Artificial Sequence
  Description of Artificial Sequence: Chemically synthesized oligonucleotide
cccgccctagcaccctggg

SEQ ID NO: 938 - DNA, 19 bp, Artificial Sequence
  Description of Artificial Sequence: Chemically synthesized oligonucleotide
cccagggtgctagggcggg

SEQ ID NO: 939 - DNA, 19 bp, Artificial Sequence
  Description of Artificial Sequence: Chemically synthesized oligonucleotide
ccgccctagcaccctgggg

SEQ ID NO: 940 - DNA, 19 bp, Artificial Sequence
  Description of Artificial Sequence: Chemically synthesized oligonucleotide
ccccagggtgctagggcgg

SEQ ID NO: 941 - DNA, 19 bp, Artificial Sequence
  Description of Artificial Sequence: Chemically synthesized oligonucleotide
cgccctagcaccctggggg

SEQ ID NO: 942 - DNA, 19 bp, Artificial Sequence
  Description of Artificial Sequence: Chemically synthesized oligonucleotide
cccccagggtgctagggcg

SEQ ID NO: 943 - DNA, 19 bp, Artificial Sequence
  Description of Artificial Sequence: Chemically synthesized oligonucleotide
gccctagcaccctgggggg

SEQ ID NO: 944 - DNA, 19 bp, Artificial Sequence
  Description of Artificial Sequence: Chemically synthesized oligonucleotide
ccccccagggtgctagggc

SEQ ID NO: 945 - DNA, 19 bp, Artificial Sequence
  Description of Artificial Sequence: Chemically synthesized oligonucleotide
ccctagcaccctggggggc

SEQ ID NO: 946 - DNA, 19 bp, Artificial Sequence
  Description of Artificial Sequence: Chemically synthesized oligonucleotide
gccccccagggtgctaggg

SEQ ID NO: 947 - DNA, 19 bp, Artificial Sequence
  Description of Artificial Sequence: Chemically synthesized oligonucleotide
cctagcaccctggggggca

SEQ ID NO: 948 - DNA, 19 bp, Artificial Sequence
  Description of Artificial Sequence: Chemically synthesized oligonucleotide
tgccccccagggtgctagg

SEQ ID NO: 949 - DNA, 19 bp, Artificial Sequence
  Description of Artificial Sequence: Chemically synthesized oligonucleotide
ctagcaccctggggggcac

SEQ ID NO: 950 - DNA, 19 bp, Artificial Sequence
  Description of Artificial Sequence: Chemically synthesized oligonucleotide
gtgccccccagggtgctag

SEQ ID NO: 951 - DNA, 19 bp, Artificial Sequence
  Description of Artificial Sequence: Chemically synthesized oligonucleotide
tagcaccctggggggcacc

SEQ ID NO: 952 - DNA, 19 bp, Artificial Sequence
  Description of Artificial Sequence: Chemically synthesized oligonucleotide
ggtgccccccagggtgcta

SEQ ID NO: 953 - DNA, 19 bp, Artificial Sequence
  Description of Artificial Sequence: Chemically synthesized oligonucleotide
agcaccctggggggcaccc

SEQ ID NO: 954 - DNA, 19 bp, Artificial Sequence
  Description of Artificial Sequence: Chemically synthesized oligonucleotide
gggtgccccccagggtgct

SEQ ID NO: 955 - DNA, 19 bp, Artificial Sequence
  Description of Artificial Sequence: Chemically synthesized oligonucleotide
gcaccctggggggcacccc

SEQ ID NO: 956 - DNA, 19 bp, Artificial Sequence
  Description of Artificial Sequence: Chemically synthesized oligonucleotide
ggggtgccccccagggtgc

SEQ ID NO: 957 - DNA, 19 bp, Artificial Sequence
  Description of Artificial Sequence: Chemically synthesized oligonucleotide
caccctggggggcaccccg

SEQ ID NO: 958 - DNA, 19 bp, Artificial Sequence
  Description of Artificial Sequence: Chemically synthesized oligonucleotide
cggggtgccccccagggtg

SEQ ID NO: 959 - DNA, 19 bp, Artificial Sequence
  Description of Artificial Sequence: Chemically synthesized oligonucleotide
accctggggggcaccccgc

SEQ ID NO: 960 - DNA, 19 bp, Artificial Sequence
  Description of Artificial Sequence: Chemically synthesized oligonucleotide
gcggggtgccccccagggt

SEQ ID NO: 961 - DNA, 19 bp, Artificial Sequence
  Description of Artificial Sequence: Chemically synthesized oligonucleotide
ccctggggggcaccccgcc

SEQ ID NO: 962 - DNA, 19 bp, Artificial Sequence
  Description of Artificial Sequence: Chemically synthesized oligonucleotide
ggcggggtgccccccaggg

SEQ ID NO: 963 - DNA, 19 bp, Artificial Sequence
  Description of Artificial Sequence: Chemically synthesized oligonucleotide
cctggggggcaccccgccc

SEQ ID NO: 964 - DNA, 19 bp, Artificial Sequence
  Description of Artificial Sequence: Chemically synthesized oligonucleotide
gggcggggtgccccccagg

SEQ ID NO: 965 - DNA, 19 bp, Artificial Sequence
  Description of Artificial Sequence: Chemically synthesized oligonucleotide
ctggggggcaccccgccca

SEQ ID NO: 966 - DNA, 19 bp, Artificial Sequence
  Description of Artificial Sequence: Chemically synthesized oligonucleotide
tgggcggggtgccccccag

SEQ ID NO: 967 - DNA, 19 bp, Artificial Sequence
  Description of Artificial Sequence: Chemically synthesized oligonucleotide
tggggggcaccccgcccaa

SEQ ID NO: 968 - DNA, 19 bp, Artificial Sequence
  Description of Artificial Sequence: Chemically synthesized oligonucleotide
ttgggcggggtgcccccca

SEQ ID NO: 969 - DNA, 19 bp, Artificial Sequence
  Description of Artificial Sequence: Chemically synthesized oligonucleotide
ggggggcaccccgcccaac

SEQ ID NO: 970 - DNA, 19 bp, Artificial Sequence
  Description of Artificial Sequence: Chemically synthesized oligonucleotide
gttgggcggggtgcccccc

SEQ ID NO: 971 - DNA, 19 bp, Artificial Sequence
  Description of Artificial Sequence: Chemically synthesized oligonucleotide
gggggcaccccgcccaacc

SEQ ID NO: 972 - DNA, 19 bp, Artificial Sequence
  Description of Artificial Sequence: Chemically synthesized oligonucleotide
ggttgggcggggtgccccc

SEQ ID NO: 973 - DNA, 19 bp, Artificial Sequence
  Description of Artificial Sequence: Chemically synthesized oligonucleotide
ggggcaccccgcccaaccg

SEQ ID NO: 974 - DNA, 19 bp, Artificial Sequence
  Description of Artificial Sequence: Chemically synthesized oligonucleotide
cggttgggcggggtgcccc

SEQ ID NO: 975 - DNA, 19 bp, Artificial Sequence
  Description of Artificial Sequence: Chemically synthesized oligonucleotide
gggcaccccgcccaaccgt

SEQ ID NO: 976 - DNA, 19 bp, Artificial Sequence
  Description of Artificial Sequence: Chemically synthesized oligonucleotide
acggttgggcggggtgccc

SEQ ID NO: 977 - DNA, 19 bp, Artificial Sequence
  Description of Artificial Sequence: Chemically synthesized oligonucleotide
ggcaccccgcccaaccgtg

SEQ ID NO: 978 - DNA, 19 bp, Artificial Sequence
  Description of Artificial Sequence: Chemically synthesized oligonucleotide
cacggttgggcggggtgcc

SEQ ID NO: 979 - DNA, 19 bp, Artificial Sequence
  Description of Artificial Sequence: Chemically synthesized oligonucleotide
gcaccccgcccaaccgtgg

SEQ ID NO: 980 - DNA, 19 bp, Artificial Sequence
  Description of Artificial Sequence: Chemically synthesized oligonucleotide
ccacggttgggcggggtgc

SEQ ID NO: 981 - DNA, 19 bp, Artificial Sequence
  Description of Artificial Sequence: Chemically synthesized oligonucleotide
caccccgcccaaccgtggc

SEQ ID NO: 982 - DNA, 19 bp, Artificial Sequence
  Description of Artificial Sequence: Chemically synthesized oligonucleotide
gccacggttgggcggggtg

SEQ ID NO: 983 - DNA, 19 bp, Artificial Sequence
  Description of Artificial Sequence: Chemically synthesized oligonucleotide
accccgcccaaccgtggcc

SEQ ID NO: 984 - DNA, 19 bp, Artificial Sequence
  Description of Artificial Sequence: Chemically synthesized oligonucleotide
ggccacggttgggcggggt

SEQ ID NO: 985 - DNA, 19 bp, Artificial Sequence
  Description of Artificial Sequence: Chemically synthesized oligonucleotide
ccccgcccaaccgtggcct

SEQ ID NO: 986 - DNA, 19 bp, Artificial Sequence
  Description of Artificial Sequence: Chemically synthesized oligonucleotide
aggccacggttgggcgggg

SEQ ID NO: 987 - DNA, 19 bp, Artificial Sequence
  Description of Artificial Sequence: Chemically synthesized oligonucleotide
cccgcccaaccgtggcctg

SEQ ID NO: 988 - DNA, 19 bp, Artificial Sequence
  Description of Artificial Sequence: Chemically synthesized oligonucleotide
caggccacggttgggcggg

SEQ ID NO: 989 - DNA, 19 bp, Artificial Sequence
  Description of Artificial Sequence: Chemically synthesized oligonucleotide
ccgcccaaccgtggcctgg

SEQ ID NO: 990 - DNA, 19 bp, Artificial Sequence
  Description of Artificial Sequence: Chemically synthesized oligonucleotide
ccaggccacggttgggcgg

SEQ ID NO: 991 - DNA, 19 bp, Artificial Sequence
  Description of Artificial Sequence: Chemically synthesized oligonucleotide
cgcccaaccgtggcctggt

SEQ ID NO: 992 - DNA, 19 bp, Artificial Sequence
  Description of Artificial Sequence: Chemically synthesized oligonucleotide
accaggccacggttgggcg

SEQ ID NO: 993 - DNA, 19 bp, Artificial Sequence
  Description of Artificial Sequence: Chemically synthesized oligonucleotide
gcccaaccgtggcctggtc

SEQ ID NO: 994 - DNA, 19 bp, Artificial Sequence
  Description of Artificial Sequence: Chemically synthesized oligonucleotide
gaccaggccacggttgggc

SEQ ID NO: 995 - DNA, 19 bp, Artificial Sequence
  Description of Artificial Sequence: Chemically synthesized oligonucleotide
cccaaccgtggcctggtcc

SEQ ID NO: 996 - DNA, 19 bp, Artificial Sequence
  Description of Artificial Sequence: Chemically synthesized oligonucleotide
ggaccaggccacggttggg

SEQ ID NO: 997 - DNA, 19 bp, Artificial Sequence
  Description of Artificial Sequence: Chemically synthesized oligonucleotide
ccaaccgtggcctggtccg

SEQ ID NO: 998 - DNA, 19 bp, Artificial Sequence
  Description of Artificial Sequence: Chemically synthesized oligonucleotide
cggaccaggccacggttgg

SEQ ID NO: 999 - DNA, 19 bp, Artificial Sequence
  Description of Artificial Sequence: Chemically synthesized oligonucleotide
caaccgtggcctggtccgg

SEQ ID NO: 1000 - DNA, 19 bp, Artificial Sequence
  Description of Artificial Sequence: Chemically synthesized oligonucleotide
ccggaccaggccacggttg

SEQ ID NO: 1001 - DNA, 19 bp, Artificial Sequence
  Description of Artificial Sequence: Chemically synthesized oligonucleotide
aaccgtggcctggtccggc

SEQ ID NO: 1002 - DNA, 19 bp, Artificial Sequence
  Description of Artificial Sequence: Chemically synthesized oligonucleotide
gccggaccaggccacggtt

SEQ ID NO: 1003 - DNA, 19 bp, Artificial Sequence
  Description of Artificial Sequence: Chemically synthesized oligonucleotide
accgtggcctggtccggcc

SEQ ID NO: 1004 - DNA, 19 bp, Artificial Sequence
  Description of Artificial Sequence: Chemically synthesized oligonucleotide
ggccggaccaggccacggt

SEQ ID NO: 1005 - DNA, 19 bp, Artificial Sequence
  Description of Artificial Sequence: Chemically synthesized oligonucleotide
ccgtggcctggtccggccc

SEQ ID NO: 1006 - DNA, 19 bp, Artificial Sequence
  Description of Artificial Sequence: Chemically synthesized oligonucleotide
gggccggaccaggccacgg

SEQ ID NO: 1007 - DNA, 19 bp, Artificial Sequence
  Description of Artificial Sequence: Chemically synthesized oligonucleotide
cgtggcctggtccggcccc

SEQ ID NO: 1008 - DNA, 19 bp, Artificial Sequence
  Description of Artificial Sequence: Chemically synthesized oligonucleotide
ggggccggaccaggccacg

SEQ ID NO: 1009 - DNA, 19 bp, Artificial Sequence
  Description of Artificial Sequence: Chemically synthesized oligonucleotide
gtggcctggtccggcccct

SEQ ID NO: 1010 - DNA, 19 bp, Artificial Sequence
  Description of Artificial Sequence: Chemically synthesized oligonucleotide
aggggccggaccaggccac

SEQ ID NO: 1011 - DNA, 19 bp, Artificial Sequence
  Description of Artificial Sequence: Chemically synthesized oligonucleotide
tggcctggtccggcccctc

SEQ ID NO: 1012 - DNA, 19 bp, Artificial Sequence
  Description of Artificial Sequence: Chemically synthesized oligonucleotide
gaggggccggaccaggcca

SEQ ID NO: 1013 - DNA, 19 bp, Artificial Sequence
  Description of Artificial Sequence: Chemically synthesized oligonucleotide
ggcctggtccggcccctcc

SEQ ID NO: 1014 - DNA, 19 bp, Artificial Sequence
  Description of Artificial Sequence: Chemically synthesized oligonucleotide
ggaggggccggaccaggcc

SEQ ID NO: 1015 - DNA, 19 bp, Artificial Sequence
  Description of Artificial Sequence: Chemically synthesized oligonucleotide
gcctggtccggcccctccc

SEQ ID NO: 1016 - DNA, 19 bp, Artificial Sequence
  Description of Artificial Sequence: Chemically synthesized oligonucleotide
gggaggggccggaccaggc

SEQ ID NO: 1017 - DNA, 19 bp, Artificial Sequence
  Description of Artificial Sequence: Chemically synthesized oligonucleotide
cctggtccggcccctcccg

SEQ ID NO: 1018 - DNA, 19 bp, Artificial Sequence
  Description of Artificial Sequence: Chemically synthesized oligonucleotide
cgggaggggccggaccagg

SEQ ID NO: 1019 - DNA, 19 bp, Artificial Sequence
  Description of Artificial Sequence: Chemically synthesized oligonucleotide
ctggtccggcccctcccgc

SEQ ID NO: 1020 - DNA, 19 bp, Artificial Sequence
  Description of Artificial Sequence: Chemically synthesized oligonucleotide
gcgggaggggccggaccag

SEQ ID NO: 1021 - DNA, 19 bp, Artificial Sequence
  Description of Artificial Sequence: Chemically synthesized oligonucleotide
tggtccggcccctcccgcc

SEQ ID NO: 1022 - DNA, 19 bp, Artificial Sequence
  Description of Artificial Sequence: Chemically synthesized oligonucleotide
ggcgggaggggccggacca

SEQ ID NO: 1023 - DNA, 19 bp, Artificial Sequence
  Description of Artificial Sequence: Chemically synthesized oligonucleotide
ggtccggcccctcccgccc

SEQ ID NO: 1024 - DNA, 19 bp, Artificial Sequence
  Description of Artificial Sequence: Chemically synthesized oligonucleotide
gggcgggaggggccggacc

SEQ ID NO: 1025 - DNA, 19 bp, Artificial Sequence
  Description of Artificial Sequence: Chemically synthesized oligonucleotide
gtccggcccctcccgccct

SEQ ID NO: 1026 - DNA, 19 bp, Artificial Sequence
  Description of Artificial Sequence: Chemically synthesized oligonucleotide
agggcgggaggggccggac

SEQ ID NO: 1027 - DNA, 19 bp, Artificial Sequence
  Description of Artificial Sequence: Chemically synthesized oligonucleotide
tccggcccctcccgccctt

SEQ ID NO: 1028 - DNA, 19 bp, Artificial Sequence
  Description of Artificial Sequence: Chemically synthesized oligonucleotide
aagggcgggaggggccgga

SEQ ID NO: 1029 - DNA, 19 bp, Artificial Sequence
  Description of Artificial Sequence: Chemically synthesized oligonucleotide
ccggcccctcccgcccttt

SEQ ID NO: 1030 - DNA, 19 bp, Artificial Sequence
  Description of Artificial Sequence: Chemically synthesized oligonucleotide
aaagggcgggaggggccgg

SEQ ID NO: 1031 - DNA, 19 bp, Artificial Sequence
  Description of Artificial Sequence: Chemically synthesized oligonucleotide
cggcccctcccgccctttg

SEQ ID NO: 1032 - DNA, 19 bp, Artificial Sequence
  Description of Artificial Sequence: Chemically synthesized oligonucleotide
caaagggcgggaggggccg

SEQ ID NO: 1033 - DNA, 19 bp, Artificial Sequence
  Description of Artificial Sequence: Chemically synthesized oligonucleotide
ggcccctcccgccctttgc

SEQ ID NO: 1034 - DNA, 19 bp, Artificial Sequence
  Description of Artificial Sequence: Chemically synthesized oligonucleotide
gcaaagggcgggaggggcc

SEQ ID NO: 1035 - DNA, 19 bp, Artificial Sequence
  Description of Artificial Sequence: Chemically synthesized oligonucleotide
gcccctcccgccctttgct

SEQ ID NO: 1036 - DNA, 19 bp, Artificial Sequence
  Description of Artificial Sequence: Chemically synthesized oligonucleotide
agcaaagggcgggaggggc

SEQ ID NO: 1037 - DNA, 19 bp, Artificial Sequence
  Description of Artificial Sequence: Chemically synthesized oligonucleotide
cccctcccgccctttgctc

SEQ ID NO: 1038 - DNA, 19 bp, Artificial Sequence
  Description of Artificial Sequence: Chemically synthesized oligonucleotide
gagcaaagggcgggagggg

SEQ ID NO: 1039 - DNA, 19 bp, Artificial Sequence
  Description of Artificial Sequence: Chemically synthesized oligonucleotide
ccctcccgccctttgctcc

SEQ ID NO: 1040 - DNA, 19 bp, Artificial Sequence
  Description of Artificial Sequence: Chemically synthesized oligonucleotide
ggagcaaagggcgggaggg

SEQ ID NO: 1041 - DNA, 19 bp, Artificial Sequence
  Description of Artificial Sequence: Chemically synthesized oligonucleotide
cctcccgccctttgctcca

SEQ ID NO: 1042 - DNA, 19 bp, Artificial Sequence
  Description of Artificial Sequence: Chemically synthesized oligonucleotide
tggagcaaagggcgggagg

SEQ ID NO: 1043 - DNA, 19 bp, Artificial Sequence
  Description of Artificial Sequence: Chemically synthesized oligonucleotide
ctcccgccctttgctccag

SEQ ID NO: 1044 - DNA, 19 bp, Artificial Sequence
  Description of Artificial Sequence: Chemically synthesized oligonucleotide
ctggagcaaagggcgggag

SEQ ID NO: 1045 - DNA, 19 bp, Artificial Sequence
  Description of Artificial Sequence: Chemically synthesized oligonucleotide
tcccgccctttgctccagt

SEQ ID NO: 1046 - DNA, 19 bp, Artificial Sequence
  Description of Artificial Sequence: Chemically synthesized oligonucleotide
actggagcaaagggcggga

SEQ ID NO: 1047 - DNA, 19 bp, Artificial Sequence
  Description of Artificial Sequence: Chemically synthesized oligonucleotide
cccgccctttgctccagtt

SEQ ID NO: 1048 - DNA, 19 bp, Artificial Sequence
  Description of Artificial Sequence: Chemically synthesized oligonucleotide
aactggagcaaagggcggg

SEQ ID NO: 1049 - DNA, 19 bp, Artificial Sequence
  Description of Artificial Sequence: Chemically synthesized oligonucleotide
ccgccctttgctccagttc

SEQ ID NO: 1050 - DNA, 19 bp, Artificial Sequence
  Description of Artificial Sequence: Chemically synthesized oligonucleotide
gaactggagcaaagggcgg

SEQ ID NO: 1051 - DNA, 19 bp, Artificial Sequence
  Description of Artificial Sequence: Chemically synthesized oligonucleotide
cgccctttgctccagttcc

SEQ ID NO: 1052 - DNA, 19 bp, Artificial Sequence
  Description of Artificial Sequence: Chemically synthesized oligonucleotide
ggaactggagcaaagggcg

SEQ ID NO: 1053 - DNA, 19 bp, Artificial Sequence
  Description of Artificial Sequence: Chemically synthesized oligonucleotide
gccctttgctccagttccc

SEQ ID NO: 1054 - DNA, 19 bp, Artificial Sequence
  Description of Artificial Sequence: Chemically synthesized oligonucleotide
gggaactggagcaaagggc

SEQ ID NO: 1055 - DNA, 19 bp, Artificial Sequence
  Description of Artificial Sequence: Chemically synthesized oligonucleotide
ccctttgctccagttcccg

SEQ ID NO: 1056 - DNA, 19 bp, Artificial Sequence
  Description of Artificial Sequence: Chemically synthesized oligonucleotide
cgggaactggagcaaaggg

SEQ ID NO: 1057 - DNA, 19 bp, Artificial Sequence
  Description of Artificial Sequence: Chemically synthesized oligonucleotide
cctttgctccagttcccgg

SEQ ID NO: 1058 - DNA, 19 bp, Artificial Sequence
  Description of Artificial Sequence: Chemically synthesized oligonucleotide
ccgggaactggagcaaagg

SEQ ID NO: 1059 - DNA, 19 bp, Artificial Sequence
  Description of Artificial Sequence: Chemically synthesized oligonucleotide
ctttgctccagttcccggg

SEQ ID NO: 1060 - DNA, 19 bp, Artificial Sequence
  Description of Artificial Sequence: Chemically synthesized oligonucleotide
cccgggaactggagcaaag

SEQ ID NO: 1061 - DNA, 19 bp, Artificial Sequence
  Description of Artificial Sequence: Chemically synthesized oligonucleotide
tttgctccagttcccgggc

SEQ ID NO: 1062 - DNA, 19 bp, Artificial Sequence
  Description of Artificial Sequence: Chemically synthesized oligonucleotide
gcccgggaactggagcaaa

SEQ ID NO: 1063 - DNA, 19 bp, Artificial Sequence
  Description of Artificial Sequence: Chemically synthesized oligonucleotide
ttgctccagttcccgggct

SEQ ID NO: 1064 - DNA, 19 bp, Artificial Sequence
  Description of Artificial Sequence: Chemically synthesized oligonucleotide
agcccgggaactggagcaa

SEQ ID NO: 1065 - DNA, 19 bp, Artificial Sequence
  Description of Artificial Sequence: Chemically synthesized oligonucleotide
tgctccagttcccgggctt

SEQ ID NO: 1066 - DNA, 19 bp, Artificial Sequence
  Description of Artificial Sequence: Chemically synthesized oligonucleotide
aagcccgggaactggagca

SEQ ID NO: 1067 - DNA, 19 bp, Artificial Sequence
  Description of Artificial Sequence: Chemically synthesized oligonucleotide
gctccagttcccgggcttg

SEQ ID NO: 1068 - DNA, 19 bp, Artificial Sequence
  Description of Artificial Sequence: Chemically synthesized oligonucleotide
caagcccgggaactggagc

SEQ ID NO: 1069 - DNA, 19 bp, Artificial Sequence
  Description of Artificial Sequence: Chemically synthesized oligonucleotide
ctccagttcccgggcttgg

SEQ ID NO: 1070 - DNA, 19 bp, Artificial Sequence
  Description of Artificial Sequence: Chemically synthesized oligonucleotide
ccaagcccgggaactggag

SEQ ID NO: 1071 - DNA, 19 bp, Artificial Sequence
  Description of Artificial Sequence: Chemically synthesized oligonucleotide
tccagttcccgggcttggc

SEQ ID NO: 1072 - DNA, 19 bp, Artificial Sequence
  Description of Artificial Sequence: Chemically synthesized oligonucleotide
gccaagcccgggaactgga

SEQ ID NO: 1073 - DNA, 19 bp, Artificial Sequence
  Description of Artificial Sequence: Chemically synthesized oligonucleotide
ccagttcccgggcttggca

SEQ ID NO: 1074 - DNA, 19 bp, Artificial Sequence
  Description of Artificial Sequence: Chemically synthesized oligonucleotide
tgccaagcccgggaactgg

SEQ ID NO: 1075 - DNA, 19 bp, Artificial Sequence
  Description of Artificial Sequence: Chemically synthesized oligonucleotide
cagttcccgggcttggcac

SEQ ID NO: 1076 - DNA, 19 bp, Artificial Sequence
  Description of Artificial Sequence: Chemically synthesized oligonucleotide
gtgccaagcccgggaactg

SEQ ID NO: 1077 - DNA, 19 bp, Artificial Sequence
  Description of Artificial Sequence: Chemically synthesized oligonucleotide
agttcccgggcttggcacc

SEQ ID NO: 1078 - DNA, 19 bp, Artificial Sequence
  Description of Artificial Sequence: Chemically synthesized oligonucleotide
ggtgccaagcccgggaact

SEQ ID NO: 1079 - DNA, 19 bp, Artificial Sequence
  Description of Artificial Sequence: Chemically synthesized oligonucleotide
gttcccgggcttggcacct

SEQ ID NO: 1080 - DNA, 19 bp, Artificial Sequence
  Description of Artificial Sequence: Chemically synthesized oligonucleotide
aggtgccaagcccgggaac

SEQ ID NO: 1081 - DNA, 19 bp, Artificial Sequence
  Description of Artificial Sequence: Chemically synthesized oligonucleotide
ttcccgggcttggcaccta

SEQ ID NO: 1082 - DNA, 19 bp, Artificial Sequence
  Description of Artificial Sequence: Chemically synthesized oligonucleotide
taggtgccaagcccgggaa

SEQ ID NO: 1083 - DNA, 19 bp, Artificial Sequence
  Description of Artificial Sequence: Chemically synthesized oligonucleotide
tcccgggcttggcacctat

SEQ ID NO: 1084 - DNA, 19 bp, Artificial Sequence
  Description of Artificial Sequence: Chemically synthesized oligonucleotide
ataggtgccaagcccggga

SEQ ID NO: 1085 - DNA, 19 bp, Artificial Sequence
  Description of Artificial Sequence: Chemically synthesized oligonucleotide
cccgggcttggcacctata

SEQ ID NO: 1086 - DNA, 19 bp, Artificial Sequence
  Description of Artificial Sequence: Chemically synthesized oligonucleotide
tataggtgccaagcccggg

SEQ ID NO: 1087 - DNA, 19 bp, Artificial Sequence
  Description of Artificial Sequence: Chemically synthesized oligonucleotide
ccgggcttggcacctatag

SEQ ID NO: 1088 - DNA, 19 bp, Artificial Sequence
  Description of Artificial Sequence: Chemically synthesized oligonucleotide
ctataggtgccaagcccgg

SEQ ID NO: 1089 - DNA, 19 bp, Artificial Sequence
  Description of Artificial Sequence: Chemically synthesized oligonucleotide
cgggcttggcacctatagt

SEQ ID NO: 1090 - DNA, 19 bp, Artificial Sequence
  Description of Artificial Sequence: Chemically synthesized oligonucleotide
actataggtgccaagcccg

SEQ ID NO: 1091 - DNA, 19 bp, Artificial Sequence
  Description of Artificial Sequence: Chemically synthesized oligonucleotide
gggcttggcacctatagtg

SEQ ID NO: 1092 - DNA, 19 bp, Artificial Sequence
  Description of Artificial Sequence: Chemically synthesized oligonucleotide
cactataggtgccaagccc

SEQ ID NO: 1093 - DNA, 19 bp, Artificial Sequence
  Description of Artificial Sequence: Chemically synthesized oligonucleotide
ggcttggcacctatagtgg

SEQ ID NO: 1094 - DNA, 19 bp, Artificial Sequence
  Description of Artificial Sequence: Chemically synthesized oligonucleotide
ccactataggtgccaagcc

SEQ ID NO: 1095 - DNA, 19 bp, Artificial Sequence
  Description of Artificial Sequence: Chemically synthesized oligonucleotide
gcttggcacctatagtggg

SEQ ID NO: 1096 - DNA, 19 bp, Artificial Sequence
  Description of Artificial Sequence: Chemically synthesized oligonucleotide
cccactataggtgccaagc

SEQ ID NO: 1097 - DNA, 19 bp, Artificial Sequence
  Description of Artificial Sequence: Chemically synthesized oligonucleotide
cttggcacctatagtgggg

SEQ ID NO: 1098 - DNA, 19 bp, Artificial Sequence
  Description of Artificial Sequence: Chemically synthesized oligonucleotide
ccccactataggtgccaag

SEQ ID NO: 1099 - DNA, 19 bp, Artificial Sequence
  Description of Artificial Sequence: Chemically synthesized oligonucleotide
ttggcacctatagtggggg

SEQ ID NO: 1100 - DNA, 19 bp, Artificial Sequence
  Description of Artificial Sequence: Chemically synthesized oligonucleotide
cccccactataggtgccaa

SEQ ID NO: 1101 - DNA, 19 bp, Artificial Sequence
  Description of Artificial Sequence: Chemically synthesized oligonucleotide
tggcacctatagtgggggt

SEQ ID NO: 1102 - DNA, 19 bp, Artificial Sequence
  Description of Artificial Sequence: Chemically synthesized oligonucleotide
acccccactataggtgcca

SEQ ID NO: 1103 - DNA, 19 bp, Artificial Sequence
  Description of Artificial Sequence: Chemically synthesized oligonucleotide
ggcacctatagtgggggtg

SEQ ID NO: 1104 - DNA, 19 bp, Artificial Sequence
  Description of Artificial Sequence: Chemically synthesized oligonucleotide
cacccccactataggtgcc

SEQ ID NO: 1105 - DNA, 19 bp, Artificial Sequence
  Description of Artificial Sequence: Chemically synthesized oligonucleotide
gcacctatagtgggggtgc

SEQ ID NO: 1106 - DNA, 19 bp, Artificial Sequence
  Description of Artificial Sequence: Chemically synthesized oligonucleotide
gcacccccactataggtgc

SEQ ID NO: 1107 - DNA, 19 bp, Artificial Sequence
  Description of Artificial Sequence: Chemically synthesized oligonucleotide
cacctatagtgggggtgcc

SEQ ID NO: 1108 - DNA, 19 bp, Artificial Sequence
  Description of Artificial Sequence: Chemically synthesized oligonucleotide
ggcacccccactataggtg

SEQ ID NO: 1109 - DNA, 19 bp, Artificial Sequence
  Description of Artificial Sequence: Chemically synthesized oligonucleotide
acctatagtgggggtgccg

SEQ ID NO: 1110 - DNA, 19 bp, Artificial Sequence
  Description of Artificial Sequence: Chemically synthesized oligonucleotide
cggcacccccactataggt

SEQ ID NO: 1111 - DNA, 19 bp, Artificial Sequence
  Description of Artificial Sequence: Chemically synthesized oligonucleotide
cctatagtgggggtgccgc

SEQ ID NO: 1112 - DNA, 19 bp, Artificial Sequence
  Description of Artificial Sequence: Chemically synthesized oligonucleotide
gcggcacccccactatagg

SEQ ID NO: 1113 - DNA, 19 bp, Artificial Sequence
  Description of Artificial Sequence: Chemically synthesized oligonucleotide
ctatagtgggggtgccgcc

SEQ ID NO: 1114 - DNA, 19 bp, Artificial Sequence
  Description of Artificial Sequence: Chemically synthesized oligonucleotide
ggcggcacccccactatag

SEQ ID NO: 1115 - DNA, 19 bp, Artificial Sequence
  Description of Artificial Sequence: Chemically synthesized oligonucleotide
tatagtgggggtgccgccc

SEQ ID NO: 1116 - DNA, 19 bp, Artificial Sequence
  Description of Artificial Sequence: Chemically synthesized oligonucleotide
gggcggcacccccactata

SEQ ID NO: 1117 - DNA, 19 bp, Artificial Sequence
  Description of Artificial Sequence: Chemically synthesized oligonucleotide
atagtgggggtgccgcccg

SEQ ID NO: 1118 - DNA, 19 bp, Artificial Sequence
  Description of Artificial Sequence: Chemically synthesized oligonucleotide
cgggcggcacccccactat

SEQ ID NO: 1119 - DNA, 19 bp, Artificial Sequence
  Description of Artificial Sequence: Chemically synthesized oligonucleotide
tagtgggggtgccgcccgc

SEQ ID NO: 1120 - DNA, 19 bp, Artificial Sequence
  Description of Artificial Sequence: Chemically synthesized oligonucleotide
gcgggcggcacccccacta

SEQ ID NO: 1121 - DNA, 19 bp, Artificial Sequence
  Description of Artificial Sequence: Chemically synthesized oligonucleotide
agtgggggtgccgcccgcc

SEQ ID NO: 1122 - DNA, 19 bp, Artificial Sequence
  Description of Artificial Sequence: Chemically synthesized oligonucleotide
ggcgggcggcacccccact

SEQ ID NO: 1123 - DNA, 19 bp, Artificial Sequence
  Description of Artificial Sequence: Chemically synthesized oligonucleotide
gtgggggtgccgcccgcct

SEQ ID NO: 1124 - DNA, 19 bp, Artificial Sequence
  Description of Artificial Sequence: Chemically synthesized oligonucleotide
aggcgggcggcacccccac

SEQ ID NO: 1125 - DNA, 19 bp, Artificial Sequence
  Description of Artificial Sequence: Chemically synthesized oligonucleotide
tgggggtgccgcccgcctg

SEQ ID NO: 1126 - DNA, 19 bp, Artificial Sequence
  Description of Artificial Sequence: Chemically synthesized oligonucleotide
caggcgggcggcaccccca

SEQ ID NO: 1127 - DNA, 19 bp, Artificial Sequence
  Description of Artificial Sequence: Chemically synthesized oligonucleotide
gggggtgccgcccgcctgc

SEQ ID NO: 1128 - DNA, 19 bp, Artificial Sequence
  Description of Artificial Sequence: Chemically synthesized oligonucleotide
gcaggcgggcggcaccccc

SEQ ID NO: 1129 - DNA, 19 bp, Artificial Sequence
  Description of Artificial Sequence: Chemically synthesized oligonucleotide
ggggtgccgcccgcctgcc

SEQ ID NO: 1130 - DNA, 19 bp, Artificial Sequence
  Description of Artificial Sequence: Chemically synthesized oligonucleotide
ggcaggcgggcggcacccc

SEQ ID NO: 1131 - DNA, 19 bp, Artificial Sequence
  Description of Artificial Sequence: Chemically synthesized oligonucleotide
gggtgccgcccgcctgcca

SEQ ID NO: 1132 - DNA, 19 bp, Artificial Sequence
  Description of Artificial Sequence: Chemically synthesized oligonucleotide
tggcaggcgggcggcaccc

SEQ ID NO: 1133 - DNA, 19 bp, Artificial Sequence
  Description of Artificial Sequence: Chemically synthesized oligonucleotide
ggtgccgcccgcctgccag

SEQ ID NO: 1134 - DNA, 19 bp, Artificial Sequence
  Description of Artificial Sequence: Chemically synthesized oligonucleotide
ctggcaggcgggcggcacc

SEQ ID NO: 1135 - DNA, 19 bp, Artificial Sequence
  Description of Artificial Sequence: Chemically synthesized oligonucleotide
gtgccgcccgcctgccagg

SEQ ID NO: 1136 - DNA, 19 bp, Artificial Sequence
  Description of Artificial Sequence: Chemically synthesized oligonucleotide
cctggcaggcgggcggcac

SEQ ID NO: 1137 - DNA, 19 bp, Artificial Sequence
  Description of Artificial Sequence: Chemically synthesized oligonucleotide
tgccgcccgcctgccaggc

SEQ ID NO: 1138 - DNA, 19 bp, Artificial Sequence
  Description of Artificial Sequence: Chemically synthesized oligonucleotide
gcctggcaggcgggcggca

SEQ ID NO: 1139 - DNA, 19 bp, Artificial Sequence
  Description of Artificial Sequence: Chemically synthesized oligonucleotide
gccgcccgcctgccaggct

SEQ ID NO: 1140 - DNA, 19 bp, Artificial Sequence
  Description of Artificial Sequence: Chemically synthesized oligonucleotide
agcctggcaggcgggcggc

SEQ ID NO: 1141 - DNA, 19 bp, Artificial Sequence
  Description of Artificial Sequence: Chemically synthesized oligonucleotide
ccgcccgcctgccaggctc

SEQ ID NO: 1142 - DNA, 19 bp, Artificial Sequence
  Description of Artificial Sequence: Chemically synthesized oligonucleotide
gagcctggcaggcgggcgg

SEQ ID NO: 1143 - DNA, 19 bp, Artificial Sequence
  Description of Artificial Sequence: Chemically synthesized oligonucleotide
cgcccgcctgccaggctcc

SEQ ID NO: 1144 - DNA, 19 bp, Artificial Sequence
  Description of Artificial Sequence: Chemically synthesized oligonucleotide
ggagcctggcaggcgggcg

SEQ ID NO: 1145 - DNA, 19 bp, Artificial Sequence
  Description of Artificial Sequence: Chemically synthesized oligonucleotide
gcccgcctgccaggctccg

SEQ ID NO: 1146 - DNA, 19 bp, Artificial Sequence
  Description of Artificial Sequence: Chemically synthesized oligonucleotide
cggagcctggcaggcgggc

SEQ ID NO: 1147 - DNA, 19 bp, Artificial Sequence
  Description of Artificial Sequence: Chemically synthesized oligonucleotide
cccgcctgccaggctccgg

SEQ ID NO: 1148 - DNA, 19 bp, Artificial Sequence
  Description of Artificial Sequence: Chemically synthesized oligonucleotide
ccggagcctggcaggcggg

SEQ ID NO: 1149 - DNA, 19 bp, Artificial Sequence
  Description of Artificial Sequence: Chemically synthesized oligonucleotide
ccgcctgccaggctccggg

SEQ ID NO: 1150 - DNA, 19 bp, Artificial Sequence
  Description of Artificial Sequence: Chemically synthesized oligonucleotide
cccggagcctggcaggcgg

SEQ ID NO: 1151 - DNA, 19 bp, Artificial Sequence
  Description of Artificial Sequence: Chemically synthesized oligonucleotide
cgcctgccaggctccgggg

SEQ ID NO: 1152 - DNA, 19 bp, Artificial Sequence
  Description of Artificial Sequence: Chemically synthesized oligonucleotide
ccccggagcctggcaggcg

SEQ ID NO: 1153 - DNA, 19 bp, Artificial Sequence
  Description of Artificial Sequence: Chemically synthesized oligonucleotide
gcctgccaggctccggggc

SEQ ID NO: 1154 - DNA, 19 bp, Artificial Sequence
  Description of Artificial Sequence: Chemically synthesized oligonucleotide
gccccggagcctggcaggc

SEQ ID NO: 1155 - DNA, 19 bp, Artificial Sequence
  Description of Artificial Sequence: Chemically synthesized oligonucleotide
cctgccaggctccggggcc

SEQ ID NO: 1156 - DNA, 19 bp, Artificial Sequence
  Description of Artificial Sequence: Chemically synthesized oligonucleotide
ggccccggagcctggcagg

SEQ ID NO: 1157 - DNA, 19 bp, Artificial Sequence
  Description of Artificial Sequence: Chemically synthesized oligonucleotide
ctgccaggctccggggccg

SEQ ID NO: 1158 - DNA, 19 bp, Artificial Sequence
  Description of Artificial Sequence: Chemically synthesized oligonucleotide
cggccccggagcctggcag

SEQ ID NO: 1159 - DNA, 19 bp, Artificial Sequence
  Description of Artificial Sequence: Chemically synthesized oligonucleotide
tgccaggctccggggccgg

SEQ ID NO: 1160 - DNA, 19 bp, Artificial Sequence
  Description of Artificial Sequence: Chemically synthesized oligonucleotide
ccggccccggagcctggca

SEQ ID NO: 1161 - DNA, 19 bp, Artificial Sequence
  Description of Artificial Sequence: Chemically synthesized oligonucleotide
gccaggctccggggccggg

SEQ ID NO: 1162 - DNA, 19 bp, Artificial Sequence
  Description of Artificial Sequence: Chemically synthesized oligonucleotide
cccggccccggagcctggc

SEQ ID NO: 1163 - DNA, 19 bp, Artificial Sequence
  Description of Artificial Sequence: Chemically synthesized oligonucleotide
ccaggctccggggccgggc

SEQ ID NO: 1164 - DNA, 19 bp, Artificial Sequence
  Description of Artificial Sequence: Chemically synthesized oligonucleotide
gcccggccccggagcctgg

SEQ ID NO: 1165 - DNA, 19 bp, Artificial Sequence
  Description of Artificial Sequence: Chemically synthesized oligonucleotide
caggctccggggccgggcc

SEQ ID NO: 1166 - DNA, 19 bp, Artificial Sequence
  Description of Artificial Sequence: Chemically synthesized oligonucleotide
ggcccggccccggagcctg

SEQ ID NO: 1167 - DNA, 19 bp, Artificial Sequence
  Description of Artificial Sequence: Chemically synthesized oligonucleotide
aggctccggggccgggccc

SEQ ID NO: 1168 - DNA, 19 bp, Artificial Sequence
  Description of Artificial Sequence: Chemically synthesized oligonucleotide
gggcccggccccggagcct

SEQ ID NO: 1169 - DNA, 19 bp, Artificial Sequence
  Description of Artificial Sequence: Chemically synthesized oligonucleotide
ggctccggggccgggccca

SEQ ID NO: 1170 - DNA, 19 bp, Artificial Sequence
  Description of Artificial Sequence: Chemically synthesized oligonucleotide
tgggcccggccccggagcc

SEQ ID NO: 1171 - DNA, 19 bp, Artificial Sequence
  Description of Artificial Sequence: Chemically synthesized oligonucleotide
gctccggggccgggcccac

SEQ ID NO: 1172 - DNA, 19 bp, Artificial Sequence
  Description of Artificial Sequence: Chemically synthesized oligonucleotide
gtgggcccggccccggagc

SEQ ID NO: 1173 - DNA, 19 bp, Artificial Sequence
  Description of Artificial Sequence: Chemically synthesized oligonucleotide
ctccggggccgggcccacg

SEQ ID NO: 1174 - DNA, 19 bp, Artificial Sequence
  Description of Artificial Sequence: Chemically synthesized oligonucleotide
cgtgggcccggccccggag

SEQ ID NO: 1175 - DNA, 19 bp, Artificial Sequence
  Description of Artificial Sequence: Chemically synthesized oligonucleotide
tccggggccgggcccacgg

SEQ ID NO: 1176 - DNA, 19 bp, Artificial Sequence
  Description of Artificial Sequence: Chemically synthesized oligonucleotide
ccgtgggcccggccccgga

SEQ ID NO: 1177 - DNA, 19 bp, Artificial Sequence
  Description of Artificial Sequence: Chemically synthesized oligonucleotide
ccggggccgggcccacggg

SEQ ID NO: 1178 - DNA, 19 bp, Artificial Sequence
  Description of Artificial Sequence: Chemically synthesized oligonucleotide
cccgtgggcccggccccgg

SEQ ID NO: 1179 - DNA, 19 bp, Artificial Sequence
  Description of Artificial Sequence: Chemically synthesized oligonucleotide
cggggccgggcccacggga

SEQ ID NO: 1180 - DNA, 19 bp, Artificial Sequence
  Description of Artificial Sequence: Chemically synthesized oligonucleotide
tcccgtgggcccggccccg

SEQ ID NO: 1181 - DNA, 19 bp, Artificial Sequence
  Description of Artificial Sequence: Chemically synthesized oligonucleotide
ggggccgggcccacgggag

SEQ ID NO: 1182 - DNA, 19 bp, Artificial Sequence
  Description of Artificial Sequence: Chemically synthesized oligonucleotide
ctcccgtgggcccggcccc

SEQ ID NO: 1183 - DNA, 19 bp, Artificial Sequence
  Description of Artificial Sequence: Chemically synthesized oligonucleotide
gggccgggcccacgggagg

SEQ ID NO: 1184 - DNA, 19 bp, Artificial Sequence
  Description of Artificial Sequence: Chemically synthesized oligonucleotide
cctcccgtgggcccggccc

SEQ ID NO: 1185 - DNA, 19 bp, Artificial Sequence
  Description of Artificial Sequence: Chemically synthesized oligonucleotide
ggccgggcccacgggaggg

SEQ ID NO: 1186 - DNA, 19 bp, Artificial Sequence
  Description of Artificial Sequence: Chemically synthesized oligonucleotide
ccctcccgtgggcccggcc

SEQ ID NO: 1187 - DNA, 19 bp, Artificial Sequence
  Description of Artificial Sequence: Chemically synthesized oligonucleotide
gccgggcccacgggagggt

SEQ ID NO: 1188 - DNA, 19 bp, Artificial Sequence
  Description of Artificial Sequence: Chemically synthesized oligonucleotide
accctcccgtgggcccggc

SEQ ID NO: 1189 - DNA, 19 bp, Artificial Sequence
  Description of Artificial Sequence: Chemically synthesized oligonucleotide
ccgggcccacgggagggtg

SEQ ID NO: 1190 - DNA, 19 bp, Artificial Sequence
  Description of Artificial Sequence: Chemically synthesized oligonucleotide
caccctcccgtgggcccgg

SEQ ID NO: 1191 - DNA, 19 bp, Artificial Sequence
  Description of Artificial Sequence: Chemically synthesized oligonucleotide
cgggcccacgggagggtgg

SEQ ID NO: 1192 - DNA, 19 bp, Artificial Sequence
  Description of Artificial Sequence: Chemically synthesized oligonucleotide
ccaccctcccgtgggcccg

SEQ ID NO: 1193 - DNA, 19 bp, Artificial Sequence
  Description of Artificial Sequence: Chemically synthesized oligonucleotide
gggcccacgggagggtggg

SEQ ID NO: 1194 - DNA, 19 bp, Artificial Sequence
  Description of Artificial Sequence: Chemically synthesized oligonucleotide
cccaccctcccgtgggccc

SEQ ID NO: 1195 - DNA, 19 bp, Artificial Sequence
  Description of Artificial Sequence: Chemically synthesized oligonucleotide
ggcccacgggagggtgggg

SEQ ID NO: 1196 - DNA, 19 bp, Artificial Sequence
  Description of Artificial Sequence: Chemically synthesized oligonucleotide
ccccaccctcccgtgggcc

SEQ ID NO: 1197 - DNA, 19 bp, Artificial Sequence
  Description of Artificial Sequence: Chemically synthesized oligonucleotide
gcccacgggagggtggggc

SEQ ID NO: 1198 - DNA, 19 bp, Artificial Sequence
  Description of Artificial Sequence: Chemically synthesized oligonucleotide
gccccaccctcccgtgggc

SEQ ID NO: 1199 - DNA, 19 bp, Artificial Sequence
  Description of Artificial Sequence: Chemically synthesized oligonucleotide
cccacgggagggtggggcg

SEQ ID NO: 1200 - DNA, 19 bp, Artificial Sequence
  Description of Artificial Sequence: Chemically synthesized oligonucleotide
cgccccaccctcccgtggg

SEQ ID NO: 1201 - DNA, 19 bp, Artificial Sequence
  Description of Artificial Sequence: Chemically synthesized oligonucleotide
ccacgggagggtggggcgg

SEQ ID NO: 1202 - DNA, 19 bp, Artificial Sequence
  Description of Artificial Sequence: Chemically synthesized oligonucleotide
ccgccccaccctcccgtgg

SEQ ID NO: 1203 - DNA, 19 bp, Artificial Sequence
  Description of Artificial Sequence: Chemically synthesized oligonucleotide
cacgggagggtggggcggc

SEQ ID NO: 1204 - DNA, 19 bp, Artificial Sequence
  Description of Artificial Sequence: Chemically synthesized oligonucleotide
gccgccccaccctcccgtg

SEQ ID NO: 1205 - DNA, 19 bp, Artificial Sequence
  Description of Artificial Sequence: Chemically synthesized oligonucleotide
acgggagggtggggcggct

SEQ ID NO: 1206 - DNA, 19 bp, Artificial Sequence
  Description of Artificial Sequence: Chemically synthesized oligonucleotide
agccgccccaccctcccgt

SEQ ID NO: 1207 - DNA, 19 bp, Artificial Sequence
  Description of Artificial Sequence: Chemically synthesized oligonucleotide
cgggagggtggggcggctg

SEQ ID NO: 1208 - DNA, 19 bp, Artificial Sequence
  Description of Artificial Sequence: Chemically synthesized oligonucleotide
cagccgccccaccctcccg

SEQ ID NO: 1209 - DNA, 19 bp, Artificial Sequence
  Description of Artificial Sequence: Chemically synthesized oligonucleotide
gggagggtggggcggctgg

SEQ ID NO: 1210 - DNA, 19 bp, Artificial Sequence
  Description of Artificial Sequence: Chemically synthesized oligonucleotide
ccagccgccccaccctccc

SEQ ID NO: 1211 - DNA, 19 bp, Artificial Sequence
  Description of Artificial Sequence: Chemically synthesized oligonucleotide
ggagggtggggcggctggg

SEQ ID NO: 1212 - DNA, 19 bp, Artificial Sequence
  Description of Artificial Sequence: Chemically synthesized oligonucleotide
cccagccgccccaccctcc

SEQ ID NO: 1213 - DNA, 19 bp, Artificial Sequence
  Description of Artificial Sequence: Chemically synthesized oligonucleotide
gagggtggggcggctggga

SEQ ID NO: 1214 - DNA, 19 bp, Artificial Sequence
  Description of Artificial Sequence: Chemically synthesized oligonucleotide
tcccagccgccccaccctc

SEQ ID NO: 1215 - DNA, 19 bp, Artificial Sequence
  Description of Artificial Sequence: Chemically synthesized oligonucleotide
agggtggggcggctgggaa

SEQ ID NO: 1216 - DNA, 19 bp, Artificial Sequence
  Description of Artificial Sequence: Chemically synthesized oligonucleotide
ttcccagccgccccaccct

SEQ ID NO: 1217 - DNA, 19 bp, Artificial Sequence
  Description of Artificial Sequence: Chemically synthesized oligonucleotide
gggtggggcggctgggaag

SEQ ID NO: 1218 - DNA, 19 bp, Artificial Sequence
  Description of Artificial Sequence: Chemically synthesized oligonucleotide
cttcccagccgccccaccc

SEQ ID NO: 1219 - DNA, 19 bp, Artificial Sequence
  Description of Artificial Sequence: Chemically synthesized oligonucleotide
ggtggggcggctgggaagc

SEQ ID NO: 1220 - DNA, 19 bp, Artificial Sequence
  Description of Artificial Sequence: Chemically synthesized oligonucleotide
gcttcccagccgccccacc

SEQ ID NO: 1221 - DNA, 19 bp, Artificial Sequence
  Description of Artificial Sequence: Chemically synthesized oligonucleotide
gtggggcggctgggaagct

SEQ ID NO: 1222 - DNA, 19 bp, Artificial Sequence
  Description of Artificial Sequence: Chemically synthesized oligonucleotide
agcttcccagccgccccac

SEQ ID NO: 1223 - DNA, 19 bp, Artificial Sequence
  Description of Artificial Sequence: Chemically synthesized oligonucleotide
tggggcggctgggaagctg

SEQ ID NO: 1224 - DNA, 19 bp, Artificial Sequence
  Description of Artificial Sequence: Chemically synthesized oligonucleotide
cagcttcccagccgcccca

SEQ ID NO: 1225 - DNA, 19 bp, Artificial Sequence
  Description of Artificial Sequence: Chemically synthesized oligonucleotide
ggggcggctgggaagctgg

SEQ ID NO: 1226 - DNA, 19 bp, Artificial Sequence
  Description of Artificial Sequence: Chemically synthesized oligonucleotide
ccagcttcccagccgcccc

SEQ ID NO: 1227 - DNA, 19 bp, Artificial Sequence
  Description of Artificial Sequence: Chemically synthesized oligonucleotide
gggcggctgggaagctggc

SEQ ID NO: 1228 - DNA, 19 bp, Artificial Sequence
  Description of Artificial Sequence: Chemically synthesized oligonucleotide
gccagcttcccagccgccc

SEQ ID NO: 1229 - DNA, 19 bp, Artificial Sequence
  Description of Artificial Sequence: Chemically synthesized oligonucleotide
ggcggctgggaagctggca

SEQ ID NO: 1230 - DNA, 19 bp, Artificial Sequence
  Description of Artificial Sequence: Chemically synthesized oligonucleotide
tgccagcttcccagccgcc

SEQ ID NO: 1231 - DNA, 19 bp, Artificial Sequence
  Description of Artificial Sequence: Chemically synthesized oligonucleotide
gcggctgggaagctggcac

SEQ ID NO: 1232 - DNA, 19 bp, Artificial Sequence
  Description of Artificial Sequence: Chemically synthesized oligonucleotide
gtgccagcttcccagccgc

SEQ ID NO: 1233 - DNA, 19 bp, Artificial Sequence
  Description of Artificial Sequence: Chemically synthesized oligonucleotide
cggctgggaagctggcacg

SEQ ID NO: 1234 - DNA, 19 bp, Artificial Sequence
  Description of Artificial Sequence: Chemically synthesized oligonucleotide
cgtgccagcttcccagccg

SEQ ID NO: 1235 - DNA, 19 bp, Artificial Sequence
  Description of Artificial Sequence: Chemically synthesized oligonucleotide
ggctgggaagctggcacgc

SEQ ID NO: 1236 - DNA, 19 bp, Artificial Sequence
  Description of Artificial Sequence: Chemically synthesized oligonucleotide
gcgtgccagcttcccagcc

SEQ ID NO: 1237 - DNA, 19 bp, Artificial Sequence
  Description of Artificial Sequence: Chemically synthesized oligonucleotide
gctgggaagctggcacgct

SEQ ID NO: 1238 - DNA, 19 bp, Artificial Sequence
  Description of Artificial Sequence: Chemically synthesized oligonucleotide
agcgtgccagcttcccagc

SEQ ID NO: 1239 - DNA, 19 bp, Artificial Sequence
  Description of Artificial Sequence: Chemically synthesized oligonucleotide
ctgggaagctggcacgctg

SEQ ID NO: 1240 - DNA, 19 bp, Artificial Sequence
  Description of Artificial Sequence: Chemically synthesized oligonucleotide
cagcgtgccagcttcccag

SEQ ID NO: 1241 - DNA, 19 bp, Artificial Sequence
  Description of Artificial Sequence: Chemically synthesized oligonucleotide
tgggaagctggcacgctgc

SEQ ID NO: 1242 - DNA, 19 bp, Artificial Sequence
  Description of Artificial Sequence: Chemically synthesized oligonucleotide
gcagcgtgccagcttccca

SEQ ID NO: 1243 - DNA, 19 bp, Artificial Sequence
  Description of Artificial Sequence: Chemically synthesized oligonucleotide
gggaagctggcacgctgcc

SEQ ID NO: 1244 - DNA, 19 bp, Artificial Sequence
  Description of Artificial Sequence: Chemically synthesized oligonucleotide
ggcagcgtgccagcttccc

SEQ ID NO: 1245 - DNA, 19 bp, Artificial Sequence
  Description of Artificial Sequence: Chemically synthesized oligonucleotide
ggaagctggcacgctgccc

SEQ ID NO: 1246 - DNA, 19 bp, Artificial Sequence
  Description of Artificial Sequence: Chemically synthesized oligonucleotide
gggcagcgtgccagcttcc

SEQ ID NO: 1247 - DNA, 19 bp, Artificial Sequence
  Description of Artificial Sequence: Chemically synthesized oligonucleotide
gaagctggcacgctgcccc

SEQ ID NO: 1248 - DNA, 19 bp, Artificial Sequence
  Description of Artificial Sequence: Chemically synthesized oligonucleotide
ggggcagcgtgccagcttc

SEQ ID NO: 1249 - DNA, 19 bp, Artificial Sequence
  Description of Artificial Sequence: Chemically synthesized oligonucleotide
aagctggcacgctgccccg

SEQ ID NO: 1250 - DNA, 19 bp, Artificial Sequence
  Description of Artificial Sequence: Chemically synthesized oligonucleotide
cggggcagcgtgccagctt

SEQ ID NO: 1251 - DNA, 19 bp, Artificial Sequence
  Description of Artificial Sequence: Chemically synthesized oligonucleotide
agctggcacgctgccccgg

SEQ ID NO: 1252 - DNA, 19 bp, Artificial Sequence
  Description of Artificial Sequence: Chemically synthesized oligonucleotide
ccggggcagcgtgccagct

SEQ ID NO: 1253 - DNA, 19 bp, Artificial Sequence
  Description of Artificial Sequence: Chemically synthesized oligonucleotide
gctggcacgctgccccggg

SEQ ID NO: 1254 - DNA, 19 bp, Artificial Sequence
  Description of Artificial Sequence: Chemically synthesized oligonucleotide
cccggggcagcgtgccagc

SEQ ID NO: 1255 - DNA, 19 bp, Artificial Sequence
  Description of Artificial Sequence: Chemically synthesized oligonucleotide
ctggcacgctgccccgggg

SEQ ID NO: 1256 - DNA, 19 bp, Artificial Sequence
  Description of Artificial Sequence: Chemically synthesized oligonucleotide
ccccggggcagcgtgccag

SEQ ID NO: 1257 - DNA, 19 bp, Artificial Sequence
  Description of Artificial Sequence: Chemically synthesized oligonucleotide
tggcacgctgccccggggg

SEQ ID NO: 1258 - DNA, 19 bp, Artificial Sequence
  Description of Artificial Sequence: Chemically synthesized oligonucleotide
cccccggggcagcgtgcca

SEQ ID NO: 1259 - DNA, 19 bp, Artificial Sequence
  Description of Artificial Sequence: Chemically synthesized oligonucleotide
ggcacgctgccccggggga

SEQ ID NO: 1260 - DNA, 19 bp, Artificial Sequence
  Description of Artificial Sequence: Chemically synthesized oligonucleotide
tcccccggggcagcgtgcc

SEQ ID NO: 1261 - DNA, 19 bp, Artificial Sequence
  Description of Artificial Sequence: Chemically synthesized oligonucleotide
gcacgctgccccgggggag

SEQ ID NO: 1262 - DNA, 19 bp, Artificial Sequence
  Description of Artificial Sequence: Chemically synthesized oligonucleotide
ctcccccggggcagcgtgc

SEQ ID NO: 1263 - DNA, 19 bp, Artificial Sequence
  Description of Artificial Sequence: Chemically synthesized oligonucleotide
cacgctgccccgggggagc

SEQ ID NO: 1264 - DNA, 19 bp, Artificial Sequence
  Description of Artificial Sequence: Chemically synthesized oligonucleotide
gctcccccggggcagcgtg

SEQ ID NO: 1265 - DNA, 19 bp, Artificial Sequence
  Description of Artificial Sequence: Chemically synthesized oligonucleotide
acgctgccccgggggagcc

SEQ ID NO: 1266 - DNA, 19 bp, Artificial Sequence
  Description of Artificial Sequence: Chemically synthesized oligonucleotide
ggctcccccggggcagcgt

SEQ ID NO: 1267 - DNA, 19 bp, Artificial Sequence
  Description of Artificial Sequence: Chemically synthesized oligonucleotide
cgctgccccgggggagcct

SEQ ID NO: 1268 - DNA, 19 bp, Artificial Sequence
  Description of Artificial Sequence: Chemically synthesized oligonucleotide
aggctcccccggggcagcg

SEQ ID NO: 1269 - DNA, 19 bp, Artificial Sequence
  Description of Artificial Sequence: Chemically synthesized oligonucleotide
gctgccccgggggagcctc

SEQ ID NO: 1270 - DNA, 19 bp, Artificial Sequence
  Description of Artificial Sequence: Chemically synthesized oligonucleotide
gaggctcccccggggcagc

SEQ ID NO: 1271 - DNA, 19 bp, Artificial Sequence
  Description of Artificial Sequence: Chemically synthesized oligonucleotide
ctgccccgggggagcctct

SEQ ID NO: 1272 - DNA, 19 bp, Artificial Sequence
  Description of Artificial Sequence: Chemically synthesized oligonucleotide
agaggctcccccggggcag

SEQ ID NO: 1273 - DNA, 19 bp, Artificial Sequence
  Description of Artificial Sequence: Chemically synthesized oligonucleotide
tgccccgggggagcctctc

SEQ ID NO: 1274 - DNA, 19 bp, Artificial Sequence
  Description of Artificial Sequence: Chemically synthesized oligonucleotide
gagaggctcccccggggca

SEQ ID NO: 1275 - DNA, 19 bp, Artificial Sequence
  Description of Artificial Sequence: Chemically synthesized oligonucleotide
gccccgggggagcctctct

SEQ ID NO: 1276 - DNA, 19 bp, Artificial Sequence
  Description of Artificial Sequence: Chemically synthesized oligonucleotide
agagaggctcccccggggc

SEQ ID NO: 1277 - DNA, 19 bp, Artificial Sequence
  Description of Artificial Sequence: Chemically synthesized oligonucleotide
ccccgggggagcctctctc

SEQ ID NO: 1278 - DNA, 19 bp, Artificial Sequence
  Description of Artificial Sequence: Chemically synthesized oligonucleotide
gagagaggctcccccgggg

SEQ ID NO: 1279 - DNA, 19 bp, Artificial Sequence
  Description of Artificial Sequence: Chemically synthesized oligonucleotide
cccgggggagcctctctcg

SEQ ID NO: 1280 - DNA, 19 bp, Artificial Sequence
  Description of Artificial Sequence: Chemically synthesized oligonucleotide
cgagagaggctcccccggg

SEQ ID NO: 1281 - DNA, 19 bp, Artificial Sequence
  Description of Artificial Sequence: Chemically synthesized oligonucleotide
ccgggggagcctctctcgg

SEQ ID NO: 1282 - DNA, 19 bp, Artificial Sequence
  Description of Artificial Sequence: Chemically synthesized oligonucleotide
ccgagagaggctcccccgg

SEQ ID NO: 1283 - DNA, 19 bp, Artificial Sequence
  Description of Artificial Sequence: Chemically synthesized oligonucleotide
cgggggagcctctctcggc

SEQ ID NO: 1284 - DNA, 19 bp, Artificial Sequence
  Description of Artificial Sequence: Chemically synthesized oligonucleotide
gccgagagaggctcccccg

SEQ ID NO: 1285 - DNA, 19 bp, Artificial Sequence
  Description of Artificial Sequence: Chemically synthesized oligonucleotide
gggggagcctctctcggca

SEQ ID NO: 1286 - DNA, 19 bp, Artificial Sequence
  Description of Artificial Sequence: Chemically synthesized oligonucleotide
tgccgagagaggctccccc

SEQ ID NO: 1287 - DNA, 19 bp, Artificial Sequence
  Description of Artificial Sequence: Chemically synthesized oligonucleotide
ggggagcctctctcggcag

SEQ ID NO: 1288 - DNA, 19 bp, Artificial Sequence
  Description of Artificial Sequence: Chemically synthesized oligonucleotide
ctgccgagagaggctcccc

SEQ ID NO: 1289 - DNA, 19 bp, Artificial Sequence
  Description of Artificial Sequence: Chemically synthesized oligonucleotide
gggagcctctctcggcagg

SEQ ID NO: 1290 - DNA, 19 bp, Artificial Sequence
  Description of Artificial Sequence: Chemically synthesized oligonucleotide
cctgccgagagaggctccc

SEQ ID NO: 1291 - DNA, 19 bp, Artificial Sequence
  Description of Artificial Sequence: Chemically synthesized oligonucleotide
ggagcctctctcggcaggc

SEQ ID NO: 1292 - DNA, 19 bp, Artificial Sequence
  Description of Artificial Sequence: Chemically synthesized oligonucleotide
gcctgccgagagaggctcc

SEQ ID NO: 1293 - DNA, 19 bp, Artificial Sequence
  Description of Artificial Sequence: Chemically synthesized oligonucleotide
gagcctctctcggcaggcg

SEQ ID NO: 1294 - DNA, 19 bp, Artificial Sequence
  Description of Artificial Sequence: Chemically synthesized oligonucleotide
cgcctgccgagagaggctc

SEQ ID NO: 1295 - DNA, 19 bp, Artificial Sequence
  Description of Artificial Sequence: Chemically synthesized oligonucleotide
agcctctctcggcaggcgc

SEQ ID NO: 1296 - DNA, 19 bp, Artificial Sequence
  Description of Artificial Sequence: Chemically synthesized oligonucleotide
gcgcctgccgagagaggct

SEQ ID NO: 1297 - DNA, 19 bp, Artificial Sequence
  Description of Artificial Sequence: Chemically synthesized oligonucleotide
gcctctctcggcaggcgcc

SEQ ID NO: 1298 - DNA, 19 bp, Artificial Sequence
  Description of Artificial Sequence: Chemically synthesized oligonucleotide
ggcgcctgccgagagaggc

SEQ ID NO: 1299 - DNA, 19 bp, Artificial Sequence
  Description of Artificial Sequence: Chemically synthesized oligonucleotide
cctctctcggcaggcgccc

SEQ ID NO: 1300 - DNA, 19 bp, Artificial Sequence
  Description of Artificial Sequence: Chemically synthesized oligonucleotide
gggcgcctgccgagagagg

SEQ ID NO: 1301 - DNA, 19 bp, Artificial Sequence
  Description of Artificial Sequence: Chemically synthesized oligonucleotide
ctctctcggcaggcgcccg

SEQ ID NO: 1302 - DNA, 19 bp, Artificial Sequence
  Description of Artificial Sequence: Chemically synthesized oligonucleotide
cgggcgcctgccgagagag

SEQ ID NO: 1303 - DNA, 19 bp, Artificial Sequence
  Description of Artificial Sequence: Chemically synthesized oligonucleotide
tctctcggcaggcgcccgg

SEQ ID NO: 1304 - DNA, 19 bp, Artificial Sequence
  Description of Artificial Sequence: Chemically synthesized oligonucleotide
ccgggcgcctgccgagaga

SEQ ID NO: 1305 - DNA, 19 bp, Artificial Sequence
  Description of Artificial Sequence: Chemically synthesized oligonucleotide
ctctcggcaggcgcccggg

SEQ ID NO: 1306 - DNA, 19 bp, Artificial Sequence
  Description of Artificial Sequence: Chemically synthesized oligonucleotide
cccgggcgcctgccgagag

SEQ ID NO: 1307 - DNA, 19 bp, Artificial Sequence
  Description of Artificial Sequence: Chemically synthesized oligonucleotide
tctcggcaggcgcccgggt

SEQ ID NO: 1308 - DNA, 19 bp, Artificial Sequence
  Description of Artificial Sequence: Chemically synthesized oligonucleotide
acccgggcgcctgccgaga

SEQ ID NO: 1309 - DNA, 19 bp, Artificial Sequence
  Description of Artificial Sequence: Chemically synthesized oligonucleotide
ctcggcaggcgcccgggtg

SEQ ID NO: 1310 - DNA, 19 bp, Artificial Sequence
  Description of Artificial Sequence: Chemically synthesized oligonucleotide
cacccgggcgcctgccgag

SEQ ID NO: 1311 - DNA, 19 bp, Artificial Sequence
  Description of Artificial Sequence: Chemically synthesized oligonucleotide
tcggcaggcgcccgggtgc

SEQ ID NO: 1312 - DNA, 19 bp, Artificial Sequence
  Description of Artificial Sequence: Chemically synthesized oligonucleotide
gcacccgggcgcctgccga

SEQ ID NO: 1313 - DNA, 19 bp, Artificial Sequence
  Description of Artificial Sequence: Chemically synthesized oligonucleotide
cggcaggcgcccgggtgcc

SEQ ID NO: 1314 - DNA, 19 bp, Artificial Sequence
  Description of Artificial Sequence: Chemically synthesized oligonucleotide
ggcacccgggcgcctgccg

SEQ ID NO: 1315 - DNA, 19 bp, Artificial Sequence
  Description of Artificial Sequence: Chemically synthesized oligonucleotide
ggcaggcgcccgggtgccg

SEQ ID NO: 1316 - DNA, 19 bp, Artificial Sequence
  Description of Artificial Sequence: Chemically synthesized oligonucleotide
cggcacccgggcgcctgcc

SEQ ID NO: 1317 - DNA, 19 bp, Artificial Sequence
  Description of Artificial Sequence: Chemically synthesized oligonucleotide
gcaggcgcccgggtgccgc

SEQ ID NO: 1318 - DNA, 19 bp, Artificial Sequence
  Description of Artificial Sequence: Chemically synthesized oligonucleotide
gcggcacccgggcgcctgc

SEQ ID NO: 1319 - DNA, 19 bp, Artificial Sequence
  Description of Artificial Sequence: Chemically synthesized oligonucleotide
caggcgcccgggtgccgcg

SEQ ID NO: 1320 - DNA, 19 bp, Artificial Sequence
  Description of Artificial Sequence: Chemically synthesized oligonucleotide
cgcggcacccgggcgcctg

SEQ ID NO: 1321 - DNA, 19 bp, Artificial Sequence
  Description of Artificial Sequence: Chemically synthesized oligonucleotide
aggcgcccgggtgccgcgg

SEQ ID NO: 1322 - DNA, 19 bp, Artificial Sequence
  Description of Artificial Sequence: Chemically synthesized oligonucleotide
ccgcggcacccgggcgcct

SEQ ID NO: 1323 - DNA, 19 bp, Artificial Sequence
  Description of Artificial Sequence: Chemically synthesized oligonucleotide
ggcgcccgggtgccgcggg

SEQ ID NO: 1324 - DNA, 19 bp, Artificial Sequence
  Description of Artificial Sequence: Chemically synthesized oligonucleotide
cccgcggcacccgggcgcc

SEQ ID NO: 1325 - DNA, 19 bp, Artificial Sequence
  Description of Artificial Sequence: Chemically synthesized oligonucleotide
gcgcccgggtgccgcgggg

SEQ ID NO: 1326 - DNA, 19 bp, Artificial Sequence
  Description of Artificial Sequence: Chemically synthesized oligonucleotide
ccccgcggcacccgggcgc

SEQ ID NO: 1327 - DNA, 19 bp, Artificial Sequence
  Description of Artificial Sequence: Chemically synthesized oligonucleotide
cgcccgggtgccgcggggg

SEQ ID NO: 1328 - DNA, 19 bp, Artificial Sequence
  Description of Artificial Sequence: Chemically synthesized oligonucleotide
cccccgcggcacccgggcg

SEQ ID NO: 1329 - DNA, 19 bp, Artificial Sequence
  Description of Artificial Sequence: Chemically synthesized oligonucleotide
gcccgggtgccgcgggggg

SEQ ID NO: 1330 - DNA, 19 bp, Artificial Sequence
  Description of Artificial Sequence: Chemically synthesized oligonucleotide
ccccccgcggcacccgggc

SEQ ID NO: 1331 - DNA, 19 bp, Artificial Sequence
  Description of Artificial Sequence: Chemically synthesized oligonucleotide
cccgggtgccgcggggggg

SEQ ID NO: 1332 - DNA, 19 bp, Artificial Sequence
  Description of Artificial Sequence: Chemically synthesized oligonucleotide
cccccccgcggcacccggg

SEQ ID NO: 1333 - DNA, 19 bp, Artificial Sequence
  Description of Artificial Sequence: Chemically synthesized oligonucleotide
ccgggtgccgcggggggga

SEQ ID NO: 1334 - DNA, 19 bp, Artificial Sequence
  Description of Artificial Sequence: Chemically synthesized oligonucleotide
tcccccccgcggcacccgg

SEQ ID NO: 1335 - DNA, 19 bp, Artificial Sequence
  Description of Artificial Sequence: Chemically synthesized oligonucleotide
cgggtgccgcgggggggag

SEQ ID NO: 1336 - DNA, 19 bp, Artificial Sequence
  Description of Artificial Sequence: Chemically synthesized oligonucleotide
ctcccccccgcggcacccg

SEQ ID NO: 1337 - DNA, 19 bp, Artificial Sequence
  Description of Artificial Sequence: Chemically synthesized oligonucleotide
gggtgccgcgggggggagg

SEQ ID NO: 1338 - DNA, 19 bp, Artificial Sequence
  Description of Artificial Sequence: Chemically synthesized oligonucleotide
cctcccccccgcggcaccc

SEQ ID NO: 1339 - DNA, 19 bp, Artificial Sequence
  Description of Artificial Sequence: Chemically synthesized oligonucleotide
ggtgccgcgggggggaggg

SEQ ID NO: 1340 - DNA, 19 bp, Artificial Sequence
  Description of Artificial Sequence: Chemically synthesized oligonucleotide
ccctcccccccgcggcacc

SEQ ID NO: 1341 - DNA, 19 bp, Artificial Sequence
  Description of Artificial Sequence: Chemically synthesized oligonucleotide
gtgccgcgggggggagggg

SEQ ID NO: 1342 - DNA, 19 bp, Artificial Sequence
  Description of Artificial Sequence: Chemically synthesized oligonucleotide
cccctcccccccgcggcac

SEQ ID NO: 1343 - DNA, 19 bp, Artificial Sequence
  Description of Artificial Sequence: Chemically synthesized oligonucleotide
tgccgcgggggggaggggg

SEQ ID NO: 1344 - DNA, 19 bp, Artificial Sequence
  Description of Artificial Sequence: Chemically synthesized oligonucleotide
ccccctcccccccgcggca

SEQ ID NO: 1345 - DNA, 19 bp, Artificial Sequence
  Description of Artificial Sequence: Chemically synthesized oligonucleotide
gccgcgggggggaggggga

SEQ ID NO: 1346 - DNA, 19 bp, Artificial Sequence
  Description of Artificial Sequence: Chemically synthesized oligonucleotide
tccccctcccccccgcggc

SEQ ID NO: 1347 - DNA, 19 bp, Artificial Sequence
  Description of Artificial Sequence: Chemically synthesized oligonucleotide
ccgcgggggggagggggaa

SEQ ID NO: 1348 - DNA, 19 bp, Artificial Sequence
  Description of Artificial Sequence: Chemically synthesized oligonucleotide
ttccccctcccccccgcgg

SEQ ID NO: 1349 - DNA, 19 bp, Artificial Sequence
  Description of Artificial Sequence: Chemically synthesized oligonucleotide
cgcgggggggagggggaac

SEQ ID NO: 1350 - DNA, 19 bp, Artificial Sequence
  Description of Artificial Sequence: Chemically synthesized oligonucleotide
gttccccctcccccccgcg

SEQ ID NO: 1351 - DNA, 19 bp, Artificial Sequence
  Description of Artificial Sequence: Chemically synthesized oligonucleotide
gcgggggggagggggaaca

SEQ ID NO: 1352 - DNA, 19 bp, Artificial Sequence
  Description of Artificial Sequence: Chemically synthesized oligonucleotide
tgttccccctcccccccgc

SEQ ID NO: 1353 - DNA, 19 bp, Artificial Sequence
  Description of Artificial Sequence: Chemically synthesized oligonucleotide
cgggggggagggggaacaa

SEQ ID NO: 1354 - DNA, 19 bp, Artificial Sequence
  Description of Artificial Sequence: Chemically synthesized oligonucleotide
ttgttccccctcccccccg

SEQ ID NO: 1355 - DNA, 19 bp, Artificial Sequence
  Description of Artificial Sequence: Chemically synthesized oligonucleotide
gggggggagggggaacaaa

SEQ ID NO: 1356 - DNA, 19 bp, Artificial Sequence
  Description of Artificial Sequence: Chemically synthesized oligonucleotide
tttgttccccctccccccc

SEQ ID NO: 1357 - DNA, 19 bp, Artificial Sequence
  Description of Artificial Sequence: Chemically synthesized oligonucleotide
ggggggagggggaacaaag

SEQ ID NO: 1358 - DNA, 19 bp, Artificial Sequence
  Description of Artificial Sequence: Chemically synthesized oligonucleotide
ctttgttccccctcccccc

SEQ ID NO: 1359 - DNA, 19 bp, Artificial Sequence
  Description of Artificial Sequence: Chemically synthesized oligonucleotide
gggggagggggaacaaagg

SEQ ID NO: 1360 - DNA, 19 bp, Artificial Sequence
  Description of Artificial Sequence: Chemically synthesized oligonucleotide
cctttgttccccctccccc

SEQ ID NO: 1361 - DNA, 19 bp, Artificial Sequence
  Description of Artificial Sequence: Chemically synthesized oligonucleotide
ggggagggggaacaaaggg

SEQ ID NO: 1362 - DNA, 19 bp, Artificial Sequence
  Description of Artificial Sequence: Chemically synthesized oligonucleotide
ccctttgttccccctcccc

SEQ ID NO: 1363 - DNA, 19 bp, Artificial Sequence
  Description of Artificial Sequence: Chemically synthesized oligonucleotide
gggagggggaacaaagggc

SEQ ID NO: 1364 - DNA, 19 bp, Artificial Sequence
  Description of Artificial Sequence: Chemically synthesized oligonucleotide
gccctttgttccccctccc

SEQ ID NO: 1365 - DNA, 19 bp, Artificial Sequence
  Description of Artificial Sequence: Chemically synthesized oligonucleotide
ggagggggaacaaagggct

SEQ ID NO: 1366 - DNA, 19 bp, Artificial Sequence
  Description of Artificial Sequence: Chemically synthesized oligonucleotide
agccctttgttccccctcc

SEQ ID NO: 1367 - DNA, 19 bp, Artificial Sequence
  Description of Artificial Sequence: Chemically synthesized oligonucleotide
gagggggaacaaagggctc

SEQ ID NO: 1368 - DNA, 19 bp, Artificial Sequence
  Description of Artificial Sequence: Chemically synthesized oligonucleotide
gagccctttgttccccctc

SEQ ID NO: 1369 - DNA, 19 bp, Artificial Sequence
  Description of Artificial Sequence: Chemically synthesized oligonucleotide
agggggaacaaagggctca

SEQ ID NO: 1370 - DNA, 19 bp, Artificial Sequence
  Description of Artificial Sequence: Chemically synthesized oligonucleotide
tgagccctttgttccccct

SEQ ID NO: 1371 - DNA, 19 bp, Artificial Sequence
  Description of Artificial Sequence: Chemically synthesized oligonucleotide
gggggaacaaagggctcat

SEQ ID NO: 1372 - DNA, 19 bp, Artificial Sequence
  Description of Artificial Sequence: Chemically synthesized oligonucleotide
atgagccctttgttccccc

SEQ ID NO: 1373 - DNA, 19 bp, Artificial Sequence
  Description of Artificial Sequence: Chemically synthesized oligonucleotide
ggggaacaaagggctcatt

SEQ ID NO: 1374 - DNA, 19 bp, Artificial Sequence
  Description of Artificial Sequence: Chemically synthesized oligonucleotide
aatgagccctttgttcccc

SEQ ID NO: 1375 - DNA, 19 bp, Artificial Sequence
  Description of Artificial Sequence: Chemically synthesized oligonucleotide
gggaacaaagggctcattc

SEQ ID NO: 1376 - DNA, 19 bp, Artificial Sequence
  Description of Artificial Sequence: Chemically synthesized oligonucleotide
gaatgagccctttgttccc

SEQ ID NO: 1377 - DNA, 19 bp, Artificial Sequence
  Description of Artificial Sequence: Chemically synthesized oligonucleotide
ggaacaaagggctcattct

SEQ ID NO: 1378 - DNA, 19 bp, Artificial Sequence
  Description of Artificial Sequence: Chemically synthesized oligonucleotide
agaatgagccctttgttcc

SEQ ID NO: 1379 - DNA, 19 bp, Artificial Sequence
  Description of Artificial Sequence: Chemically synthesized oligonucleotide
gaacaaagggctcattctc

SEQ ID NO: 1380 - DNA, 19 bp, Artificial Sequence
  Description of Artificial Sequence: Chemically synthesized oligonucleotide
gagaatgagccctttgttc

SEQ ID NO: 1381 - DNA, 19 bp, Artificial Sequence
  Description of Artificial Sequence: Chemically synthesized oligonucleotide
aacaaagggctcattctcc

SEQ ID NO: 1382 - DNA, 19 bp, Artificial Sequence
  Description of Artificial Sequence: Chemically synthesized oligonucleotide
ggagaatgagccctttgtt

SEQ ID NO: 1383 - DNA, 19 bp, Artificial Sequence
  Description of Artificial Sequence: Chemically synthesized oligonucleotide
acaaagggctcattctccc

SEQ ID NO: 1384 - DNA, 19 bp, Artificial Sequence
  Description of Artificial Sequence: Chemically synthesized oligonucleotide
gggagaatgagccctttgt

SEQ ID NO: 1385 - DNA, 19 bp, Artificial Sequence
  Description of Artificial Sequence: Chemically synthesized oligonucleotide
caaagggctcattctcccc

SEQ ID NO: 1386 - DNA, 19 bp, Artificial Sequence
  Description of Artificial Sequence: Chemically synthesized oligonucleotide
ggggagaatgagccctttg

SEQ ID NO: 1387 - DNA, 19 bp, Artificial Sequence
  Description of Artificial Sequence: Chemically synthesized oligonucleotide
aaagggctcattctccccg

SEQ ID NO: 1388 - DNA, 19 bp, Artificial Sequence
  Description of Artificial Sequence: Chemically synthesized oligonucleotide
cggggagaatgagcccttt

SEQ ID NO: 1389 - DNA, 19 bp, Artificial Sequence
  Description of Artificial Sequence: Chemically synthesized oligonucleotide
aagggctcattctccccgt

SEQ ID NO: 1390 - DNA, 19 bp, Artificial Sequence
  Description of Artificial Sequence: Chemically synthesized oligonucleotide
acggggagaatgagccctt

SEQ ID NO: 1391 - DNA, 19 bp, Artificial Sequence
  Description of Artificial Sequence: Chemically synthesized oligonucleotide
agggctcattctccccgtg

SEQ ID NO: 1392 - DNA, 19 bp, Artificial Sequence
  Description of Artificial Sequence: Chemically synthesized oligonucleotide
cacggggagaatgagccct

SEQ ID NO: 1393 - DNA, 19 bp, Artificial Sequence
  Description of Artificial Sequence: Chemically synthesized oligonucleotide
gggctcattctccccgtgc

SEQ ID NO: 1394 - DNA, 19 bp, Artificial Sequence
  Description of Artificial Sequence: Chemically synthesized oligonucleotide
gcacggggagaatgagccc

SEQ ID NO: 1395 - DNA, 19 bp, Artificial Sequence
  Description of Artificial Sequence: Chemically synthesized oligonucleotide
ggctcattctccccgtgcg

SEQ ID NO: 1396 - DNA, 19 bp, Artificial Sequence
  Description of Artificial Sequence: Chemically synthesized oligonucleotide
cgcacggggagaatgagcc

SEQ ID NO: 1397 - DNA, 19 bp, Artificial Sequence
  Description of Artificial Sequence: Chemically synthesized oligonucleotide
gctcattctccccgtgcgc

SEQ ID NO: 1398 - DNA, 19 bp, Artificial Sequence
  Description of Artificial Sequence: Chemically synthesized oligonucleotide
gcgcacggggagaatgagc

SEQ ID NO: 1399 - DNA, 19 bp, Artificial Sequence
  Description of Artificial Sequence: Chemically synthesized oligonucleotide
ctcattctccccgtgcgca

SEQ ID NO: 1400 - DNA, 19 bp, Artificial Sequence
  Description of Artificial Sequence: Chemically synthesized oligonucleotide
tgcgcacggggagaatgag

SEQ ID NO: 1401 - DNA, 19 bp, Artificial Sequence
  Description of Artificial Sequence: Chemically synthesized oligonucleotide
tcattctccccgtgcgcag

SEQ ID NO: 1402 - DNA, 19 bp, Artificial Sequence
  Description of Artificial Sequence: Chemically synthesized oligonucleotide
ctgcgcacggggagaatga

SEQ ID NO: 1403 - DNA, 19 bp, Artificial Sequence
  Description of Artificial Sequence: Chemically synthesized oligonucleotide
cattctccccgtgcgcagc

SEQ ID NO: 1404 - DNA, 19 bp, Artificial Sequence
  Description of Artificial Sequence: Chemically synthesized oligonucleotide
gctgcgcacggggagaatg

SEQ ID NO: 1405 - DNA, 19 bp, Artificial Sequence
  Description of Artificial Sequence: Chemically synthesized oligonucleotide
attctccccgtgcgcagcc

SEQ ID NO: 1406 - DNA, 19 bp, Artificial Sequence
  Description of Artificial Sequence: Chemically synthesized oligonucleotide
ggctgcgcacggggagaat

SEQ ID NO: 1407 - DNA, 19 bp, Artificial Sequence
  Description of Artificial Sequence: Chemically synthesized oligonucleotide
ttctccccgtgcgcagccg

SEQ ID NO: 1408 - DNA, 19 bp, Artificial Sequence
  Description of Artificial Sequence: Chemically synthesized oligonucleotide
cggctgcgcacggggagaa

SEQ ID NO: 1409 - DNA, 19 bp, Artificial Sequence
  Description of Artificial Sequence: Chemically synthesized oligonucleotide
tctccccgtgcgcagccgg

SEQ ID NO: 1410 - DNA, 19 bp, Artificial Sequence
  Description of Artificial Sequence: Chemically synthesized oligonucleotide
ccggctgcgcacggggaga

SEQ ID NO: 1411 - DNA, 19 bp, Artificial Sequence
  Description of Artificial Sequence: Chemically synthesized oligonucleotide
ctccccgtgcgcagccggt

SEQ ID NO: 1412 - DNA, 19 bp, Artificial Sequence
  Description of Artificial Sequence: Chemically synthesized oligonucleotide
accggctgcgcacggggag

SEQ ID NO: 1413 - DNA, 19 bp, Artificial Sequence
  Description of Artificial Sequence: Chemically synthesized oligonucleotide
tccccgtgcgcagccggtg

SEQ ID NO: 1414 - DNA, 19 bp, Artificial Sequence
  Description of Artificial Sequence: Chemically synthesized oligonucleotide
caccggctgcgcacgggga

SEQ ID NO: 1415 - DNA, 19 bp, Artificial Sequence
  Description of Artificial Sequence: Chemically synthesized oligonucleotide
ccccgtgcgcagccggtgg

SEQ ID NO: 1416 - DNA, 19 bp, Artificial Sequence
  Description of Artificial Sequence: Chemically synthesized oligonucleotide
ccaccggctgcgcacgggg

SEQ ID NO: 1417 - DNA, 19 bp, Artificial Sequence
  Description of Artificial Sequence: Chemically synthesized oligonucleotide
cccgtgcgcagccggtggc

SEQ ID NO: 1418 - DNA, 19 bp, Artificial Sequence
  Description of Artificial Sequence: Chemically synthesized oligonucleotide
gccaccggctgcgcacggg

SEQ ID NO: 1419 - DNA, 19 bp, Artificial Sequence
  Description of Artificial Sequence: Chemically synthesized oligonucleotide
ccgtgcgcagccggtggca

SEQ ID NO: 1420 - DNA, 19 bp, Artificial Sequence
  Description of Artificial Sequence: Chemically synthesized oligonucleotide
tgccaccggctgcgcacgg

SEQ ID NO: 1421 - DNA, 19 bp, Artificial Sequence
  Description of Artificial Sequence: Chemically synthesized oligonucleotide
cgtgcgcagccggtggcat

SEQ ID NO: 1422 - DNA, 19 bp, Artificial Sequence
  Description of Artificial Sequence: Chemically synthesized oligonucleotide
atgccaccggctgcgcacg

SEQ ID NO: 1423 - DNA, 19 bp, Artificial Sequence
  Description of Artificial Sequence: Chemically synthesized oligonucleotide
gtgcgcagccggtggcatc

SEQ ID NO: 1424 - DNA, 19 bp, Artificial Sequence
  Description of Artificial Sequence: Chemically synthesized oligonucleotide
gatgccaccggctgcgcac

SEQ ID NO: 1425 - DNA, 19 bp, Artificial Sequence
  Description of Artificial Sequence: Chemically synthesized oligonucleotide
tgcgcagccggtggcatcg

SEQ ID NO: 1426 - DNA, 19 bp, Artificial Sequence
  Description of Artificial Sequence: Chemically synthesized oligonucleotide
cgatgccaccggctgcgca

SEQ ID NO: 1427 - DNA, 19 bp, Artificial Sequence
  Description of Artificial Sequence: Chemically synthesized oligonucleotide
gcgcagccggtggcatcgc

SEQ ID NO: 1428 - DNA, 19 bp, Artificial Sequence
  Description of Artificial Sequence: Chemically synthesized oligonucleotide
gcgatgccaccggctgcgc

SEQ ID NO: 1429 - DNA, 19 bp, Artificial Sequence
  Description of Artificial Sequence: Chemically synthesized oligonucleotide
cgcagccggtggcatcgcc

SEQ ID NO: 1430 - DNA, 19 bp, Artificial Sequence
  Description of Artificial Sequence: Chemically synthesized oligonucleotide
ggcgatgccaccggctgcg

SEQ ID NO: 1431 - DNA, 19 bp, Artificial Sequence
  Description of Artificial Sequence: Chemically synthesized oligonucleotide
gcagccggtggcatcgccg

SEQ ID NO: 1432 - DNA, 19 bp, Artificial Sequence
  Description of Artificial Sequence: Chemically synthesized oligonucleotide
cggcgatgccaccggctgc

SEQ ID NO: 1433 - DNA, 19 bp, Artificial Sequence
  Description of Artificial Sequence: Chemically synthesized oligonucleotide
cagccggtggcatcgccgg

SEQ ID NO: 1434 - DNA, 19 bp, Artificial Sequence
  Description of Artificial Sequence: Chemically synthesized oligonucleotide
ccggcgatgccaccggctg

SEQ ID NO: 1435 - DNA, 19 bp, Artificial Sequence
  Description of Artificial Sequence: Chemically synthesized oligonucleotide
agccggtggcatcgccggg

SEQ ID NO: 1436 - DNA, 19 bp, Artificial Sequence
  Description of Artificial Sequence: Chemically synthesized oligonucleotide
cccggcgatgccaccggct

SEQ ID NO: 1437 - DNA, 19 bp, Artificial Sequence
  Description of Artificial Sequence: Chemically synthesized oligonucleotide
gccggtggcatcgccgggg

SEQ ID NO: 1438 - DNA, 19 bp, Artificial Sequence
  Description of Artificial Sequence: Chemically synthesized oligonucleotide
ccccggcgatgccaccggc

SEQ ID NO: 1439 - DNA, 19 bp, Artificial Sequence
  Description of Artificial Sequence: Chemically synthesized oligonucleotide
ccggtggcatcgccggggc

SEQ ID NO: 1440 - DNA, 19 bp, Artificial Sequence
  Description of Artificial Sequence: Chemically synthesized oligonucleotide
gccccggcgatgccaccgg

SEQ ID NO: 1441 - DNA, 19 bp, Artificial Sequence
  Description of Artificial Sequence: Chemically synthesized oligonucleotide
cggtggcatcgccggggcg

SEQ ID NO: 1442 - DNA, 19 bp, Artificial Sequence
  Description of Artificial Sequence: Chemically synthesized oligonucleotide
cgccccggcgatgccaccg

SEQ ID NO: 1443 - DNA, 19 bp, Artificial Sequence
  Description of Artificial Sequence: Chemically synthesized oligonucleotide
ggtggcatcgccggggcgt

SEQ ID NO: 1444 - DNA, 19 bp, Artificial Sequence
  Description of Artificial Sequence: Chemically synthesized oligonucleotide
acgccccggcgatgccacc

SEQ ID NO: 1445 - DNA, 19 bp, Artificial Sequence
  Description of Artificial Sequence: Chemically synthesized oligonucleotide
gtggcatcgccggggcgtt

SEQ ID NO: 1446 - DNA, 19 bp, Artificial Sequence
  Description of Artificial Sequence: Chemically synthesized oligonucleotide
aacgccccggcgatgccac

SEQ ID NO: 1447 - DNA, 19 bp, Artificial Sequence
  Description of Artificial Sequence: Chemically synthesized oligonucleotide
tggcatcgccggggcgttg

SEQ ID NO: 1448 - DNA, 19 bp, Artificial Sequence
  Description of Artificial Sequence: Chemically synthesized oligonucleotide
caacgccccggcgatgcca

SEQ ID NO: 1449 - DNA, 19 bp, Artificial Sequence
  Description of Artificial Sequence: Chemically synthesized oligonucleotide
ggcatcgccggggcgttgg

SEQ ID NO: 1450 - DNA, 19 bp, Artificial Sequence
  Description of Artificial Sequence: Chemically synthesized oligonucleotide
ccaacgccccggcgatgcc

SEQ ID NO: 1451 - DNA, 19 bp, Artificial Sequence
  Description of Artificial Sequence: Chemically synthesized oligonucleotide
gcatcgccggggcgttggc

SEQ ID NO: 1452 - DNA, 19 bp, Artificial Sequence
  Description of Artificial Sequence: Chemically synthesized oligonucleotide
gccaacgccccggcgatgc

SEQ ID NO: 1453 - DNA, 19 bp, Artificial Sequence
  Description of Artificial Sequence: Chemically synthesized oligonucleotide
catcgccggggcgttggcg

SEQ ID NO: 1454 - DNA, 19 bp, Artificial Sequence
  Description of Artificial Sequence: Chemically synthesized oligonucleotide
cgccaacgccccggcgatg

SEQ ID NO: 1455 - DNA, 19 bp, Artificial Sequence
  Description of Artificial Sequence: Chemically synthesized oligonucleotide
atcgccggggcgttggcgg

SEQ ID NO: 1456 - DNA, 19 bp, Artificial Sequence
  Description of Artificial Sequence: Chemically synthesized oligonucleotide
ccgccaacgccccggcgat

SEQ ID NO: 1457 - DNA, 19 bp, Artificial Sequence
  Description of Artificial Sequence: Chemically synthesized oligonucleotide
tcgccggggcgttggcgga

SEQ ID NO: 1458 - DNA, 19 bp, Artificial Sequence
  Description of Artificial Sequence: Chemically synthesized oligonucleotide
tccgccaacgccccggcga

SEQ ID NO: 1459 - DNA, 19 bp, Artificial Sequence
  Description of Artificial Sequence: Chemically synthesized oligonucleotide
cgccggggcgttggcggaa

SEQ ID NO: 1460 - DNA, 19 bp, Artificial Sequence
  Description of Artificial Sequence: Chemically synthesized oligonucleotide
ttccgccaacgccccggcg

SEQ ID NO: 1461 - DNA, 19 bp, Artificial Sequence
  Description of Artificial Sequence: Chemically synthesized oligonucleotide
gccggggcgttggcggaag

SEQ ID NO: 1462 - DNA, 19 bp, Artificial Sequence
  Description of Artificial Sequence: Chemically synthesized oligonucleotide
cttccgccaacgccccggc

SEQ ID NO: 1463 - DNA, 19 bp, Artificial Sequence
  Description of Artificial Sequence: Chemically synthesized oligonucleotide
ccggggcgttggcggaagc

SEQ ID NO: 1464 - DNA, 19 bp, Artificial Sequence
  Description of Artificial Sequence: Chemically synthesized oligonucleotide
gcttccgccaacgccccgg

SEQ ID NO: 1465 - DNA, 19 bp, Artificial Sequence
  Description of Artificial Sequence: Chemically synthesized oligonucleotide
cggggcgttggcggaagcc

SEQ ID NO: 1466 - DNA, 19 bp, Artificial Sequence
  Description of Artificial Sequence: Chemically synthesized oligonucleotide
ggcttccgccaacgccccg

SEQ ID NO: 1467 - DNA, 19 bp, Artificial Sequence
  Description of Artificial Sequence: Chemically synthesized oligonucleotide
ggggcgttggcggaagccc

SEQ ID NO: 1468 - DNA, 19 bp, Artificial Sequence
  Description of Artificial Sequence: Chemically synthesized oligonucleotide
gggcttccgccaacgcccc

SEQ ID NO: 1469 - DNA, 19 bp, Artificial Sequence
  Description of Artificial Sequence: Chemically synthesized oligonucleotide
gggcgttggcggaagcccc

SEQ ID NO: 1470 - DNA, 19 bp, Artificial Sequence
  Description of Artificial Sequence: Chemically synthesized oligonucleotide
ggggcttccgccaacgccc

SEQ ID NO: 1471 - DNA, 19 bp, Artificial Sequence
  Description of Artificial Sequence: Chemically synthesized oligonucleotide
ggcgttggcggaagccccc

SEQ ID NO: 1472 - DNA, 19 bp, Artificial Sequence
  Description of Artificial Sequence: Chemically synthesized oligonucleotide
gggggcttccgccaacgcc

SEQ ID NO: 1473 - DNA, 19 bp, Artificial Sequence
  Description of Artificial Sequence: Chemically synthesized oligonucleotide
gcgttggcggaagcccccg

SEQ ID NO: 1474 - DNA, 19 bp, Artificial Sequence
  Description of Artificial Sequence: Chemically synthesized oligonucleotide
cgggggcttccgccaacgc

SEQ ID NO: 1475 - DNA, 19 bp, Artificial Sequence
  Description of Artificial Sequence: Chemically synthesized oligonucleotide
cgttggcggaagcccccgg

SEQ ID NO: 1476 - DNA, 19 bp, Artificial Sequence
  Description of Artificial Sequence: Chemically synthesized oligonucleotide
ccgggggcttccgccaacg

SEQ ID NO: 1477 - DNA, 19 bp, Artificial Sequence
  Description of Artificial Sequence: Chemically synthesized oligonucleotide
gttggcggaagcccccggg

SEQ ID NO: 1478 - DNA, 19 bp, Artificial Sequence
  Description of Artificial Sequence: Chemically synthesized oligonucleotide
cccgggggcttccgccaac

SEQ ID NO: 1479 - DNA, 19 bp, Artificial Sequence
  Description of Artificial Sequence: Chemically synthesized oligonucleotide
ttggcggaagcccccgggg

SEQ ID NO: 1480 - DNA, 19 bp, Artificial Sequence
  Description of Artificial Sequence: Chemically synthesized oligonucleotide
ccccgggggcttccgccaa

SEQ ID NO: 1481 - DNA, 19 bp, Artificial Sequence
  Description of Artificial Sequence: Chemically synthesized oligonucleotide
tggcggaagcccccggggc

SEQ ID NO: 1482 - DNA, 19 bp, Artificial Sequence
  Description of Artificial Sequence: Chemically synthesized oligonucleotide
gccccgggggcttccgcca

SEQ ID NO: 1483 - DNA, 19 bp, Artificial Sequence
  Description of Artificial Sequence: Chemically synthesized oligonucleotide
ggcggaagcccccggggcc

SEQ ID NO: 1484 - DNA, 19 bp, Artificial Sequence
  Description of Artificial Sequence: Chemically synthesized oligonucleotide
ggccccgggggcttccgcc

SEQ ID NO: 1485 - DNA, 19 bp, Artificial Sequence
  Description of Artificial Sequence: Chemically synthesized oligonucleotide
gcggaagcccccggggccc

SEQ ID NO: 1486 - DNA, 19 bp, Artificial Sequence
  Description of Artificial Sequence: Chemically synthesized oligonucleotide
gggccccgggggcttccgc

SEQ ID NO: 1487 - DNA, 19 bp, Artificial Sequence
  Description of Artificial Sequence: Chemically synthesized oligonucleotide
cggaagcccccggggcccg

SEQ ID NO: 1488 - DNA, 19 bp, Artificial Sequence
  Description of Artificial Sequence: Chemically synthesized oligonucleotide
cgggccccgggggcttccg

SEQ ID NO: 1489 - DNA, 19 bp, Artificial Sequence
  Description of Artificial Sequence: Chemically synthesized oligonucleotide
ggaagcccccggggcccgg

SEQ ID NO: 1490 - DNA, 19 bp, Artificial Sequence
  Description of Artificial Sequence: Chemically synthesized oligonucleotide
ccgggccccgggggcttcc

SEQ ID NO: 1491 - DNA, 19 bp, Artificial Sequence
  Description of Artificial Sequence: Chemically synthesized oligonucleotide
gaagcccccggggcccggg

SEQ ID NO: 1492 - DNA, 19 bp, Artificial Sequence
  Description of Artificial Sequence: Chemically synthesized oligonucleotide
cccgggccccgggggcttc

SEQ ID NO: 1493 - DNA, 19 bp, Artificial Sequence
  Description of Artificial Sequence: Chemically synthesized oligonucleotide
aagcccccggggcccggga

SEQ ID NO: 1494 - DNA, 19 bp, Artificial Sequence
  Description of Artificial Sequence: Chemically synthesized oligonucleotide
tcccgggccccgggggctt

SEQ ID NO: 1495 - DNA, 19 bp, Artificial Sequence
  Description of Artificial Sequence: Chemically synthesized oligonucleotide
agcccccggggcccgggag

SEQ ID NO: 1496 - DNA, 19 bp, Artificial Sequence
  Description of Artificial Sequence: Chemically synthesized oligonucleotide
ctcccgggccccgggggct

SEQ ID NO: 1497 - DNA, 19 bp, Artificial Sequence
  Description of Artificial Sequence: Chemically synthesized oligonucleotide
gcccccggggcccgggagg

SEQ ID NO: 1498 - DNA, 19 bp, Artificial Sequence
  Description of Artificial Sequence: Chemically synthesized oligonucleotide
cctcccgggccccgggggc

SEQ ID NO: 1499 - DNA, 19 bp, Artificial Sequence
  Description of Artificial Sequence: Chemically synthesized oligonucleotide
cccccggggcccgggaggg

SEQ ID NO: 1500 - DNA, 19 bp, Artificial Sequence
  Description of Artificial Sequence: Chemically synthesized oligonucleotide
ccctcccgggccccggggg

SEQ ID NO: 1501 - DNA, 19 bp, Artificial Sequence
  Description of Artificial Sequence: Chemically synthesized oligonucleotide
ccccggggcccgggagggg

SEQ ID NO: 1502 - DNA, 19 bp, Artificial Sequence
  Description of Artificial Sequence: Chemically synthesized oligonucleotide
cccctcccgggccccgggg

SEQ ID NO: 1503 - DNA, 19 bp, Artificial Sequence
  Description of Artificial Sequence: Chemically synthesized oligonucleotide
cccggggcccgggaggggg

SEQ ID NO: 1504 - DNA, 19 bp, Artificial Sequence
  Description of Artificial Sequence: Chemically synthesized oligonucleotide
ccccctcccgggccccggg

SEQ ID NO: 1505 - DNA, 19 bp, Artificial Sequence
  Description of Artificial Sequence: Chemically synthesized oligonucleotide
ccggggcccgggagggggc

SEQ ID NO: 1506 - DNA, 19 bp, Artificial Sequence
  Description of Artificial Sequence: Chemically synthesized oligonucleotide
gccccctcccgggccccgg

SEQ ID NO: 1507 - DNA, 19 bp, Artificial Sequence
  Description of Artificial Sequence: Chemically synthesized oligonucleotide
cggggcccgggagggggca

SEQ ID NO: 1508 - DNA, 19 bp, Artificial Sequence
  Description of Artificial Sequence: Chemically synthesized oligonucleotide
tgccccctcccgggccccg

SEQ ID NO: 1509 - DNA, 19 bp, Artificial Sequence
  Description of Artificial Sequence: Chemically synthesized oligonucleotide
ggggcccgggagggggcag

SEQ ID NO: 1510 - DNA, 19 bp, Artificial Sequence
  Description of Artificial Sequence: Chemically synthesized oligonucleotide
ctgccccctcccgggcccc

SEQ ID NO: 1511 - DNA, 19 bp, Artificial Sequence
  Description of Artificial Sequence: Chemically synthesized oligonucleotide
gggcccgggagggggcagg

SEQ ID NO: 1512 - DNA, 19 bp, Artificial Sequence
  Description of Artificial Sequence: Chemically synthesized oligonucleotide
cctgccccctcccgggccc

SEQ ID NO: 1513 - DNA, 19 bp, Artificial Sequence
  Description of Artificial Sequence: Chemically synthesized oligonucleotide
ggcccgggagggggcaggc

SEQ ID NO: 1514 - DNA, 19 bp, Artificial Sequence
  Description of Artificial Sequence: Chemically synthesized oligonucleotide
gcctgccccctcccgggcc

SEQ ID NO: 1515 - DNA, 19 bp, Artificial Sequence
  Description of Artificial Sequence: Chemically synthesized oligonucleotide
gcccgggagggggcaggcc

SEQ ID NO: 1516 - DNA, 19 bp, Artificial Sequence
  Description of Artificial Sequence: Chemically synthesized oligonucleotide
ggcctgccccctcccgggc

SEQ ID NO: 1517 - DNA, 19 bp, Artificial Sequence
  Description of Artificial Sequence: Chemically synthesized oligonucleotide
cccgggagggggcaggccc

SEQ ID NO: 1518 - DNA, 19 bp, Artificial Sequence
  Description of Artificial Sequence: Chemically synthesized oligonucleotide
gggcctgccccctcccggg

SEQ ID NO: 1519 - DNA, 19 bp, Artificial Sequence
  Description of Artificial Sequence: Chemically synthesized oligonucleotide
ccgggagggggcaggccca

SEQ ID NO: 1520 - DNA, 19 bp, Artificial Sequence
  Description of Artificial Sequence: Chemically synthesized oligonucleotide
tgggcctgccccctcccgg

SEQ ID NO: 1521 - DNA, 19 bp, Artificial Sequence
  Description of Artificial Sequence: Chemically synthesized oligonucleotide
cgggagggggcaggcccag

SEQ ID NO: 1522 - DNA, 19 bp, Artificial Sequence
  Description of Artificial Sequence: Chemically synthesized oligonucleotide
ctgggcctgccccctcccg

SEQ ID NO: 1523 - DNA, 19 bp, Artificial Sequence
  Description of Artificial Sequence: Chemically synthesized oligonucleotide
gggagggggcaggcccagg

SEQ ID NO: 1524 - DNA, 19 bp, Artificial Sequence
  Description of Artificial Sequence: Chemically synthesized oligonucleotide
cctgggcctgccccctccc

SEQ ID NO: 1525 - DNA, 19 bp, Artificial Sequence
  Description of Artificial Sequence: Chemically synthesized oligonucleotide
ggagggggcaggcccaggc

SEQ ID NO: 1526 - DNA, 19 bp, Artificial Sequence
  Description of Artificial Sequence: Chemically synthesized oligonucleotide
gcctgggcctgccccctcc

SEQ ID NO: 1527 - DNA, 19 bp, Artificial Sequence
  Description of Artificial Sequence: Chemically synthesized oligonucleotide
gagggggcaggcccaggcg

SEQ ID NO: 1528 - DNA, 19 bp, Artificial Sequence
  Description of Artificial Sequence: Chemically synthesized oligonucleotide
cgcctgggcctgccccctc

SEQ ID NO: 1529 - DNA, 19 bp, Artificial Sequence
  Description of Artificial Sequence: Chemically synthesized oligonucleotide
agggggcaggcccaggcgc

SEQ ID NO: 1530 - DNA, 19 bp, Artificial Sequence
  Description of Artificial Sequence: Chemically synthesized oligonucleotide
gcgcctgggcctgccccct

SEQ ID NO: 1531 - DNA, 19 bp, Artificial Sequence
  Description of Artificial Sequence: Chemically synthesized oligonucleotide
gggggcaggcccaggcgcg

SEQ ID NO: 1532 - DNA, 19 bp, Artificial Sequence
  Description of Artificial Sequence: Chemically synthesized oligonucleotide
cgcgcctgggcctgccccc

SEQ ID NO: 1533 - DNA, 19 bp, Artificial Sequence
  Description of Artificial Sequence: Chemically synthesized oligonucleotide
ggggcaggcccaggcgcgg

SEQ ID NO: 1534 - DNA, 19 bp, Artificial Sequence
  Description of Artificial Sequence: Chemically synthesized oligonucleotide
ccgcgcctgggcctgcccc

SEQ ID NO: 1535 - DNA, 19 bp, Artificial Sequence
  Description of Artificial Sequence: Chemically synthesized oligonucleotide
gggcaggcccaggcgcggc

SEQ ID NO: 1536 - DNA, 19 bp, Artificial Sequence
  Description of Artificial Sequence: Chemically synthesized oligonucleotide
gccgcgcctgggcctgccc

SEQ ID NO: 1537 - DNA, 19 bp, Artificial Sequence
  Description of Artificial Sequence: Chemically synthesized oligonucleotide
ggcaggcccaggcgcggcc

SEQ ID NO: 1538 - DNA, 19 bp, Artificial Sequence
  Description of Artificial Sequence: Chemically synthesized oligonucleotide
ggccgcgcctgggcctgcc

SEQ ID NO: 1539 - DNA, 19 bp, Artificial Sequence
  Description of Artificial Sequence: Chemically synthesized oligonucleotide
gcaggcccaggcgcggccg

SEQ ID NO: 1540 - DNA, 19 bp, Artificial Sequence
  Description of Artificial Sequence: Chemically synthesized oligonucleotide
cggccgcgcctgggcctgc

SEQ ID NO: 1541 - DNA, 19 bp, Artificial Sequence
  Description of Artificial Sequence: Chemically synthesized oligonucleotide
caggcccaggcgcggccgc

SEQ ID NO: 1542 - DNA, 19 bp, Artificial Sequence
  Description of Artificial Sequence: Chemically synthesized oligonucleotide
gcggccgcgcctgggcctg

SEQ ID NO: 1543 - DNA, 19 bp, Artificial Sequence
  Description of Artificial Sequence: Chemically synthesized oligonucleotide
aggcccaggcgcggccgcc

SEQ ID NO: 1544 - DNA, 19 bp, Artificial Sequence
  Description of Artificial Sequence: Chemically synthesized oligonucleotide
ggcggccgcgcctgggcct

SEQ ID NO: 1545 - DNA, 19 bp, Artificial Sequence
  Description of Artificial Sequence: Chemically synthesized oligonucleotide
ggcccaggcgcggccgccg

SEQ ID NO: 1546 - DNA, 19 bp, Artificial Sequence
  Description of Artificial Sequence: Chemically synthesized oligonucleotide
cggcggccgcgcctgggcc

SEQ ID NO: 1547 - DNA, 19 bp, Artificial Sequence
  Description of Artificial Sequence: Chemically synthesized oligonucleotide
gcccaggcgcggccgccga

SEQ ID NO: 1548 - DNA, 19 bp, Artificial Sequence
  Description of Artificial Sequence: Chemically synthesized oligonucleotide
tcggcggccgcgcctgggc

SEQ ID NO: 1549 - DNA, 19 bp, Artificial Sequence
  Description of Artificial Sequence: Chemically synthesized oligonucleotide
cccaggcgcggccgccgaa

SEQ ID NO: 1550 - DNA, 19 bp, Artificial Sequence
  Description of Artificial Sequence: Chemically synthesized oligonucleotide
ttcggcggccgcgcctggg

SEQ ID NO: 1551 - DNA, 19 bp, Artificial Sequence
  Description of Artificial Sequence: Chemically synthesized oligonucleotide
ccaggcgcggccgccgaat

SEQ ID NO: 1552 - DNA, 19 bp, Artificial Sequence
  Description of Artificial Sequence: Chemically synthesized oligonucleotide
attcggcggccgcgcctgg

SEQ ID NO: 1553 - DNA, 19 bp, Artificial Sequence
  Description of Artificial Sequence: Chemically synthesized oligonucleotide
caggcgcggccgccgaatc

SEQ ID NO: 1554 - DNA, 19 bp, Artificial Sequence
  Description of Artificial Sequence: Chemically synthesized oligonucleotide
gattcggcggccgcgcctg

SEQ ID NO: 1555 - DNA, 19 bp, Artificial Sequence
  Description of Artificial Sequence: Chemically synthesized oligonucleotide
aggcgcggccgccgaatca

SEQ ID NO: 1556 - DNA, 19 bp, Artificial Sequence
  Description of Artificial Sequence: Chemically synthesized oligonucleotide
tgattcggcggccgcgcct

SEQ ID NO: 1557 - DNA, 19 bp, Artificial Sequence
  Description of Artificial Sequence: Chemically synthesized oligonucleotide
ggcgcggccgccgaatcac

SEQ ID NO: 1558 - DNA, 19 bp, Artificial Sequence
  Description of Artificial Sequence: Chemically synthesized oligonucleotide
gtgattcggcggccgcgcc

SEQ ID NO: 1559 - DNA, 19 bp, Artificial Sequence
  Description of Artificial Sequence: Chemically synthesized oligonucleotide
gcgcggccgccgaatcacg

SEQ ID NO: 1560 - DNA, 19 bp, Artificial Sequence
  Description of Artificial Sequence: Chemically synthesized oligonucleotide
cgtgattcggcggccgcgc

SEQ ID NO: 1561 - DNA, 19 bp, Artificial Sequence
  Description of Artificial Sequence: Chemically synthesized oligonucleotide
cgcggccgccgaatcacgg

SEQ ID NO: 1562 - DNA, 19 bp, Artificial Sequence
  Description of Artificial Sequence: Chemically synthesized oligonucleotide
ccgtgattcggcggccgcg

SEQ ID NO: 1563 - DNA, 19 bp, Artificial Sequence
  Description of Artificial Sequence: Chemically synthesized oligonucleotide
gcggccgccgaatcacggg

SEQ ID NO: 1564 - DNA, 19 bp, Artificial Sequence
  Description of Artificial Sequence: Chemically synthesized oligonucleotide
cccgtgattcggcggccgc

SEQ ID NO: 1565 - DNA, 19 bp, Artificial Sequence
  Description of Artificial Sequence: Chemically synthesized oligonucleotide
cggccgccgaatcacgggc

SEQ ID NO: 1566 - DNA, 19 bp, Artificial Sequence
  Description of Artificial Sequence: Chemically synthesized oligonucleotide
gcccgtgattcggcggccg

SEQ ID NO: 1567 - DNA, 19 bp, Artificial Sequence
  Description of Artificial Sequence: Chemically synthesized oligonucleotide
ggccgccgaatcacgggct

SEQ ID NO: 1568 - DNA, 19 bp, Artificial Sequence
  Description of Artificial Sequence: Chemically synthesized oligonucleotide
agcccgtgattcggcggcc

SEQ ID NO: 1569 - DNA, 19 bp, Artificial Sequence
  Description of Artificial Sequence: Chemically synthesized oligonucleotide
gccgccgaatcacgggctc

SEQ ID NO: 1570 - DNA, 19 bp, Artificial Sequence
  Description of Artificial Sequence: Chemically synthesized oligonucleotide
gagcccgtgattcggcggc

SEQ ID NO: 1571 - DNA, 19 bp, Artificial Sequence
  Description of Artificial Sequence: Chemically synthesized oligonucleotide
ccgccgaatcacgggctcc

SEQ ID NO: 1572 - DNA, 19 bp, Artificial Sequence
  Description of Artificial Sequence: Chemically synthesized oligonucleotide
ggagcccgtgattcggcgg

SEQ ID NO: 1573 - DNA, 19 bp, Artificial Sequence
  Description of Artificial Sequence: Chemically synthesized oligonucleotide
cgccgaatcacgggctcct

SEQ ID NO: 1574 - DNA, 19 bp, Artificial Sequence
  Description of Artificial Sequence: Chemically synthesized oligonucleotide
aggagcccgtgattcggcg

SEQ ID NO: 1575 - DNA, 19 bp, Artificial Sequence
  Description of Artificial Sequence: Chemically synthesized oligonucleotide
gccgaatcacgggctcctg

SEQ ID NO: 1576 - DNA, 19 bp, Artificial Sequence
  Description of Artificial Sequence: Chemically synthesized oligonucleotide
caggagcccgtgattcggc

SEQ ID NO: 1577 - DNA, 19 bp, Artificial Sequence
  Description of Artificial Sequence: Chemically synthesized oligonucleotide
ccgaatcacgggctcctgt

SEQ ID NO: 1578 - DNA, 19 bp, Artificial Sequence
  Description of Artificial Sequence: Chemically synthesized oligonucleotide
acaggagcccgtgattcgg

SEQ ID NO: 1579 - DNA, 19 bp, Artificial Sequence
  Description of Artificial Sequence: Chemically synthesized oligonucleotide
cgaatcacgggctcctgtt

SEQ ID NO: 1580 - DNA, 19 bp, Artificial Sequence
  Description of Artificial Sequence: Chemically synthesized oligonucleotide
aacaggagcccgtgattcg

SEQ ID NO: 1581 - DNA, 19 bp, Artificial Sequence
  Description of Artificial Sequence: Chemically synthesized oligonucleotide
gaatcacgggctcctgttt

SEQ ID NO: 1582 - DNA, 19 bp, Artificial Sequence
  Description of Artificial Sequence: Chemically synthesized oligonucleotide
aaacaggagcccgtgattc

SEQ ID NO: 1583 - DNA, 19 bp, Artificial Sequence
  Description of Artificial Sequence: Chemically synthesized oligonucleotide
aatcacgggctcctgtttc

SEQ ID NO: 1584 - DNA, 19 bp, Artificial Sequence
  Description of Artificial Sequence: Chemically synthesized oligonucleotide
gaaacaggagcccgtgatt

SEQ ID NO: 1585 - DNA, 19 bp, Artificial Sequence
  Description of Artificial Sequence: Chemically synthesized oligonucleotide
atcacgggctcctgtttcc

SEQ ID NO: 1586 - DNA, 19 bp, Artificial Sequence
  Description of Artificial Sequence: Chemically synthesized oligonucleotide
ggaaacaggagcccgtgat

SEQ ID NO: 1587 - DNA, 19 bp, Artificial Sequence
  Description of Artificial Sequence: Chemically synthesized oligonucleotide
tcacgggctcctgtttccc

SEQ ID NO: 1588 - DNA, 19 bp, Artificial Sequence
  Description of Artificial Sequence: Chemically synthesized oligonucleotide
gggaaacaggagcccgtga

SEQ ID NO: 1589 - DNA, 19 bp, Artificial Sequence
  Description of Artificial Sequence: Chemically synthesized oligonucleotide
cacgggctcctgtttcccg

SEQ ID NO: 1590 - DNA, 19 bp, Artificial Sequence
  Description of Artificial Sequence: Chemically synthesized oligonucleotide
cgggaaacaggagcccgtg

SEQ ID NO: 1591 - DNA, 19 bp, Artificial Sequence
  Description of Artificial Sequence: Chemically synthesized oligonucleotide
acgggctcctgtttcccgc

SEQ ID NO: 1592 - DNA, 19 bp, Artificial Sequence
  Description of Artificial Sequence: Chemically synthesized oligonucleotide
gcgggaaacaggagcccgt

SEQ ID NO: 1593 - DNA, 19 bp, Artificial Sequence
  Description of Artificial Sequence: Chemically synthesized oligonucleotide
cgggctcctgtttcccgca

SEQ ID NO: 1594 - DNA, 19 bp, Artificial Sequence
  Description of Artificial Sequence: Chemically synthesized oligonucleotide
tgcgggaaacaggagcccg

SEQ ID NO: 1595 - DNA, 19 bp, Artificial Sequence
  Description of Artificial Sequence: Chemically synthesized oligonucleotide
gggctcctgtttcccgcag

SEQ ID NO: 1596 - DNA, 19 bp, Artificial Sequence
  Description of Artificial Sequence: Chemically synthesized oligonucleotide
ctgcgggaaacaggagccc

SEQ ID NO: 1597 - DNA, 19 bp, Artificial Sequence
  Description of Artificial Sequence: Chemically synthesized oligonucleotide
ggctcctgtttcccgcagg

SEQ ID NO: 1598 - DNA, 19 bp, Artificial Sequence
  Description of Artificial Sequence: Chemically synthesized oligonucleotide
cctgcgggaaacaggagcc

SEQ ID NO: 1599 - DNA, 19 bp, Artificial Sequence
  Description of Artificial Sequence: Chemically synthesized oligonucleotide
gctcctgtttcccgcaggg

SEQ ID NO: 1600 - DNA, 19 bp, Artificial Sequence
  Description of Artificial Sequence: Chemically synthesized oligonucleotide
ccctgcgggaaacaggagc

SEQ ID NO: 1601 - DNA, 19 bp, Artificial Sequence
  Description of Artificial Sequence: Chemically synthesized oligonucleotide
ctcctgtttcccgcagggt

SEQ ID NO: 1602 - DNA, 19 bp, Artificial Sequence
  Description of Artificial Sequence: Chemically synthesized oligonucleotide
accctgcgggaaacaggag

SEQ ID NO: 1603 - DNA, 19 bp, Artificial Sequence
  Description of Artificial Sequence: Chemically synthesized oligonucleotide
tcctgtttcccgcagggtg

SEQ ID NO: 1604 - DNA, 19 bp, Artificial Sequence
  Description of Artificial Sequence: Chemically synthesized oligonucleotide
caccctgcgggaaacagga

SEQ ID NO: 1605 - DNA, 19 bp, Artificial Sequence
  Description of Artificial Sequence: Chemically synthesized oligonucleotide
cctgtttcccgcagggtgc

SEQ ID NO: 1606 - DNA, 19 bp, Artificial Sequence
  Description of Artificial Sequence: Chemically synthesized oligonucleotide
gcaccctgcgggaaacagg

SEQ ID NO: 1607 - DNA, 19 bp, Artificial Sequence
  Description of Artificial Sequence: Chemically synthesized oligonucleotide
ctgtttcccgcagggtgct

SEQ ID NO: 1608 - DNA, 19 bp, Artificial Sequence
  Description of Artificial Sequence: Chemically synthesized oligonucleotide
agcaccctgcgggaaacag

SEQ ID NO: 1609 - DNA, 19 bp, Artificial Sequence
  Description of Artificial Sequence: Chemically synthesized oligonucleotide
tgtttcccgcagggtgctg

SEQ ID NO: 1610 - DNA, 19 bp, Artificial Sequence
  Description of Artificial Sequence: Chemically synthesized oligonucleotide
cagcaccctgcgggaaaca

SEQ ID NO: 1611 - DNA, 19 bp, Artificial Sequence
  Description of Artificial Sequence: Chemically synthesized oligonucleotide
gtttcccgcagggtgctgg

SEQ ID NO: 1612 - DNA, 19 bp, Artificial Sequence
  Description of Artificial Sequence: Chemically synthesized oligonucleotide
ccagcaccctgcgggaaac

SEQ ID NO: 1613 - DNA, 19 bp, Artificial Sequence
  Description of Artificial Sequence: Chemically synthesized oligonucleotide
tttcccgcagggtgctgga

SEQ ID NO: 1614 - DNA, 19 bp, Artificial Sequence
  Description of Artificial Sequence: Chemically synthesized oligonucleotide
tccagcaccctgcgggaaa

SEQ ID NO: 1615 - DNA, 19 bp, Artificial Sequence
  Description of Artificial Sequence: Chemically synthesized oligonucleotide
ttcccgcagggtgctggag

SEQ ID NO: 1616 - DNA, 19 bp, Artificial Sequence
  Description of Artificial Sequence: Chemically synthesized oligonucleotide
ctccagcaccctgcgggaa

SEQ ID NO: 1617 - DNA, 19 bp, Artificial Sequence
  Description of Artificial Sequence: Chemically synthesized oligonucleotide
tcccgcagggtgctggagg

SEQ ID NO: 1618 - DNA, 19 bp, Artificial Sequence
  Description of Artificial Sequence: Chemically synthesized oligonucleotide
cctccagcaccctgcggga

SEQ ID NO: 1619 - DNA, 19 bp, Artificial Sequence
  Description of Artificial Sequence: Chemically synthesized oligonucleotide
cccgcagggtgctggagga

SEQ ID NO: 1620 - DNA, 19 bp, Artificial Sequence
  Description of Artificial Sequence: Chemically synthesized oligonucleotide
tcctccagcaccctgcggg

SEQ ID NO: 1621 - DNA, 19 bp, Artificial Sequence
  Description of Artificial Sequence: Chemically synthesized oligonucleotide
ccgcagggtgctggaggag

SEQ ID NO: 1622 - DNA, 19 bp, Artificial Sequence
  Description of Artificial Sequence: Chemically synthesized oligonucleotide
ctcctccagcaccctgcgg

SEQ ID NO: 1623 - DNA, 19 bp, Artificial Sequence
  Description of Artificial Sequence: Chemically synthesized oligonucleotide
cgcagggtgctggaggagg

SEQ ID NO: 1624 - DNA, 19 bp, Artificial Sequence
  Description of Artificial Sequence: Chemically synthesized oligonucleotide
cctcctccagcaccctgcg

SEQ ID NO: 1625 - DNA, 19 bp, Artificial Sequence
  Description of Artificial Sequence: Chemically synthesized oligonucleotide
gcagggtgctggaggagga

SEQ ID NO: 1626 - DNA, 19 bp, Artificial Sequence
  Description of Artificial Sequence: Chemically synthesized oligonucleotide
tcctcctccagcaccctgc

SEQ ID NO: 1627 - DNA, 19 bp, Artificial Sequence
  Description of Artificial Sequence: Chemically synthesized oligonucleotide
cagggtgctggaggaggaa

SEQ ID NO: 1628 - DNA, 19 bp, Artificial Sequence
  Description of Artificial Sequence: Chemically synthesized oligonucleotide
ttcctcctccagcaccctg

SEQ ID NO: 1629 - DNA, 19 bp, Artificial Sequence
  Description of Artificial Sequence: Chemically synthesized oligonucleotide
agggtgctggaggaggaaa

SEQ ID NO: 1630 - DNA, 19 bp, Artificial Sequence
  Description of Artificial Sequence: Chemically synthesized oligonucleotide
tttcctcctccagcaccct

SEQ ID NO: 1631 - DNA, 19 bp, Artificial Sequence
  Description of Artificial Sequence: Chemically synthesized oligonucleotide
gggtgctggaggaggaaac

SEQ ID NO: 1632 - DNA, 19 bp, Artificial Sequence
  Description of Artificial Sequence: Chemically synthesized oligonucleotide
gtttcctcctccagcaccc

SEQ ID NO: 1633 - DNA, 19 bp, Artificial Sequence
  Description of Artificial Sequence: Chemically synthesized oligonucleotide
ggtgctggaggaggaaacc

SEQ ID NO: 1634 - DNA, 19 bp, Artificial Sequence
  Description of Artificial Sequence: Chemically synthesized oligonucleotide
ggtttcctcctccagcacc

SEQ ID NO: 1635 - DNA, 19 bp, Artificial Sequence
  Description of Artificial Sequence: Chemically synthesized oligonucleotide
gtgctggaggaggaaaccg

SEQ ID NO: 1636 - DNA, 19 bp, Artificial Sequence
  Description of Artificial Sequence: Chemically synthesized oligonucleotide
cggtttcctcctccagcac

SEQ ID NO: 1637 - DNA, 19 bp, Artificial Sequence
  Description of Artificial Sequence: Chemically synthesized oligonucleotide
tgctggaggaggaaaccgg

SEQ ID NO: 1638 - DNA, 19 bp, Artificial Sequence
  Description of Artificial Sequence: Chemically synthesized oligonucleotide
ccggtttcctcctccagca

SEQ ID NO: 1639 - DNA, 19 bp, Artificial Sequence
  Description of Artificial Sequence: Chemically synthesized oligonucleotide
gctggaggaggaaaccggc

SEQ ID NO: 1640 - DNA, 19 bp, Artificial Sequence
  Description of Artificial Sequence: Chemically synthesized oligonucleotide
gccggtttcctcctccagc

SEQ ID NO: 1641 - DNA, 19 bp, Artificial Sequence
  Description of Artificial Sequence: Chemically synthesized oligonucleotide
ctggaggaggaaaccggcg

SEQ ID NO: 1642 - DNA, 19 bp, Artificial Sequence
  Description of Artificial Sequence: Chemically synthesized oligonucleotide
cgccggtttcctcctccag

SEQ ID NO: 1643 - DNA, 19 bp, Artificial Sequence
  Description of Artificial Sequence: Chemically synthesized oligonucleotide
tggaggaggaaaccggcgg

SEQ ID NO: 1644 - DNA, 19 bp, Artificial Sequence
  Description of Artificial Sequence: Chemically synthesized oligonucleotide
ccgccggtttcctcctcca

SEQ ID NO: 1645 - DNA, 19 bp, Artificial Sequence
  Description of Artificial Sequence: Chemically synthesized oligonucleotide
ggaggaggaaaccggcgga

SEQ ID NO: 1646 - DNA, 19 bp, Artificial Sequence
  Description of Artificial Sequence: Chemically synthesized oligonucleotide
tccgccggtttcctcctcc

SEQ ID NO: 1647 - DNA, 19 bp, Artificial Sequence
  Description of Artificial Sequence: Chemically synthesized oligonucleotide
gaggaggaaaccggcggag

SEQ ID NO: 1648 - DNA, 19 bp, Artificial Sequence
  Description of Artificial Sequence: Chemically synthesized oligonucleotide
ctccgccggtttcctcctc

SEQ ID NO: 1649 - DNA, 19 bp, Artificial Sequence
  Description of Artificial Sequence: Chemically synthesized oligonucleotide
aggaggaaaccggcggagc

SEQ ID NO: 1650 - DNA, 19 bp, Artificial Sequence
  Description of Artificial Sequence: Chemically synthesized oligonucleotide
gctccgccggtttcctcct

SEQ ID NO: 1651 - DNA, 19 bp, Artificial Sequence
  Description of Artificial Sequence: Chemically synthesized oligonucleotide
ggaggaaaccggcggagca

SEQ ID NO: 1652 - DNA, 19 bp, Artificial Sequence
  Description of Artificial Sequence: Chemically synthesized oligonucleotide
tgctccgccggtttcctcc

SEQ ID NO: 1653 - DNA, 19 bp, Artificial Sequence
  Description of Artificial Sequence: Chemically synthesized oligonucleotide
gaggaaaccggcggagcag

SEQ ID NO: 1654 - DNA, 19 bp, Artificial Sequence
  Description of Artificial Sequence: Chemically synthesized oligonucleotide
ctgctccgccggtttcctc

SEQ ID NO: 1655 - DNA, 19 bp, Artificial Sequence
  Description of Artificial Sequence: Chemically synthesized oligonucleotide
aggaaaccggcggagcagc

SEQ ID NO: 1656 - DNA, 19 bp, Artificial Sequence
  Description of Artificial Sequence: Chemically synthesized oligonucleotide
gctgctccgccggtttcct

SEQ ID NO: 1657 - DNA, 19 bp, Artificial Sequence
  Description of Artificial Sequence: Chemically synthesized oligonucleotide
ggaaaccggcggagcagct

SEQ ID NO: 1658 - DNA, 19 bp, Artificial Sequence
  Description of Artificial Sequence: Chemically synthesized oligonucleotide
agctgctccgccggtttcc

SEQ ID NO: 1659 - DNA, 19 bp, Artificial Sequence
  Description of Artificial Sequence: Chemically synthesized oligonucleotide
gaaaccggcggagcagctt

SEQ ID NO: 1660 - DNA, 19 bp, Artificial Sequence
  Description of Artificial Sequence: Chemically synthesized oligonucleotide
aagctgctccgccggtttc

SEQ ID NO: 1661 - DNA, 19 bp, Artificial Sequence
  Description of Artificial Sequence: Chemically synthesized oligonucleotide
aaaccggcggagcagcttc

SEQ ID NO: 1662 - DNA, 19 bp, Artificial Sequence
  Description of Artificial Sequence: Chemically synthesized oligonucleotide
gaagctgctccgccggttt

SEQ ID NO: 1663 - DNA, 19 bp, Artificial Sequence
  Description of Artificial Sequence: Chemically synthesized oligonucleotide
aaccggcggagcagcttcc

SEQ ID NO: 1664 - DNA, 19 bp, Artificial Sequence
  Description of Artificial Sequence: Chemically synthesized oligonucleotide
ggaagctgctccgccggtt

SEQ ID NO: 1665 - DNA, 19 bp, Artificial Sequence
  Description of Artificial Sequence: Chemically synthesized oligonucleotide
accggcggagcagcttccc

SEQ ID NO: 1666 - DNA, 19 bp, Artificial Sequence
  Description of Artificial Sequence: Chemically synthesized oligonucleotide
gggaagctgctccgccggt

SEQ ID NO: 1667 - DNA, 19 bp, Artificial Sequence
  Description of Artificial Sequence: Chemically synthesized oligonucleotide
ccggcggagcagcttcccc

SEQ ID NO: 1668 - DNA, 19 bp, Artificial Sequence
  Description of Artificial Sequence: Chemically synthesized oligonucleotide
ggggaagctgctccgccgg

SEQ ID NO: 1669 - DNA, 19 bp, Artificial Sequence
  Description of Artificial Sequence: Chemically synthesized oligonucleotide
cggcggagcagcttcccca

SEQ ID NO: 1670 - DNA, 19 bp, Artificial Sequence
  Description of Artificial Sequence: Chemically synthesized oligonucleotide
tggggaagctgctccgccg

SEQ ID NO: 1671 - DNA, 19 bp, Artificial Sequence
  Description of Artificial Sequence: Chemically synthesized oligonucleotide
ggcggagcagcttccccac

SEQ ID NO: 1672 - DNA, 19 bp, Artificial Sequence
  Description of Artificial Sequence: Chemically synthesized oligonucleotide
gtggggaagctgctccgcc

SEQ ID NO: 1673 - DNA, 19 bp, Artificial Sequence
  Description of Artificial Sequence: Chemically synthesized oligonucleotide
gcggagcagcttccccact

SEQ ID NO: 1674 - DNA, 19 bp, Artificial Sequence
  Description of Artificial Sequence: Chemically synthesized oligonucleotide
agtggggaagctgctccgc

SEQ ID NO: 1675 - DNA, 19 bp, Artificial Sequence
  Description of Artificial Sequence: Chemically synthesized oligonucleotide
cggagcagcttccccactc

SEQ ID NO: 1676 - DNA, 19 bp, Artificial Sequence
  Description of Artificial Sequence: Chemically synthesized oligonucleotide
gagtggggaagctgctccg

SEQ ID NO: 1677 - DNA, 19 bp, Artificial Sequence
  Description of Artificial Sequence: Chemically synthesized oligonucleotide
ggagcagcttccccactct

SEQ ID NO: 1678 - DNA, 19 bp, Artificial Sequence
  Description of Artificial Sequence: Chemically synthesized oligonucleotide
agagtggggaagctgctcc

SEQ ID NO: 1679 - DNA, 19 bp, Artificial Sequence
  Description of Artificial Sequence: Chemically synthesized oligonucleotide
gagcagcttccccactctc

SEQ ID NO: 1680 - DNA, 19 bp, Artificial Sequence
  Description of Artificial Sequence: Chemically synthesized oligonucleotide
gagagtggggaagctgctc

SEQ ID NO: 1681 - DNA, 19 bp, Artificial Sequence
  Description of Artificial Sequence: Chemically synthesized oligonucleotide
agcagcttccccactctca

SEQ ID NO: 1682 - DNA, 19 bp, Artificial Sequence
  Description of Artificial Sequence: Chemically synthesized oligonucleotide
tgagagtggggaagctgct

SEQ ID NO: 1683 - DNA, 19 bp, Artificial Sequence
  Description of Artificial Sequence: Chemically synthesized oligonucleotide
gcagcttccccactctcag

SEQ ID NO: 1684 - DNA, 19 bp, Artificial Sequence
  Description of Artificial Sequence: Chemically synthesized oligonucleotide
ctgagagtggggaagctgc

SEQ ID NO: 1685 - DNA, 19 bp, Artificial Sequence
  Description of Artificial Sequence: Chemically synthesized oligonucleotide
cagcttccccactctcagt

SEQ ID NO: 1686 - DNA, 19 bp, Artificial Sequence
  Description of Artificial Sequence: Chemically synthesized oligonucleotide
actgagagtggggaagctg

SEQ ID NO: 1687 - DNA, 19 bp, Artificial Sequence
  Description of Artificial Sequence: Chemically synthesized oligonucleotide
agcttccccactctcagtt

SEQ ID NO: 1688 - DNA, 19 bp, Artificial Sequence
  Description of Artificial Sequence: Chemically synthesized oligonucleotide
aactgagagtggggaagct

SEQ ID NO: 1689 - DNA, 19 bp, Artificial Sequence
  Description of Artificial Sequence: Chemically synthesized oligonucleotide
gcttccccactctcagttg

SEQ ID NO: 1690 - DNA, 19 bp, Artificial Sequence
  Description of Artificial Sequence: Chemically synthesized oligonucleotide
caactgagagtggggaagc

SEQ ID NO: 1691 - DNA, 19 bp, Artificial Sequence
  Description of Artificial Sequence: Chemically synthesized oligonucleotide
cttccccactctcagttgc

SEQ ID NO: 1692 - DNA, 19 bp, Artificial Sequence
  Description of Artificial Sequence: Chemically synthesized oligonucleotide
gcaactgagagtggggaag

SEQ ID NO: 1693 - DNA, 19 bp, Artificial Sequence
  Description of Artificial Sequence: Chemically synthesized oligonucleotide
ttccccactctcagttgcg

SEQ ID NO: 1694 - DNA, 19 bp, Artificial Sequence
  Description of Artificial Sequence: Chemically synthesized oligonucleotide
cgcaactgagagtggggaa

SEQ ID NO: 1695 - DNA, 19 bp, Artificial Sequence
  Description of Artificial Sequence: Chemically synthesized oligonucleotide
tccccactctcagttgcgc

SEQ ID NO: 1696 - DNA, 19 bp, Artificial Sequence
  Description of Artificial Sequence: Chemically synthesized oligonucleotide
gcgcaactgagagtgggga

SEQ ID NO: 1697 - DNA, 19 bp, Artificial Sequence
  Description of Artificial Sequence: Chemically synthesized oligonucleotide
ccccactctcagttgcgct

SEQ ID NO: 1698 - DNA, 19 bp, Artificial Sequence
  Description of Artificial Sequence: Chemically synthesized oligonucleotide
agcgcaactgagagtgggg

SEQ ID NO: 1699 - DNA, 19 bp, Artificial Sequence
  Description of Artificial Sequence: Chemically synthesized oligonucleotide
cccactctcagttgcgctt

SEQ ID NO: 1700 - DNA, 19 bp, Artificial Sequence
  Description of Artificial Sequence: Chemically synthesized oligonucleotide
aagcgcaactgagagtggg

SEQ ID NO: 1701 - DNA, 19 bp, Artificial Sequence
  Description of Artificial Sequence: Chemically synthesized oligonucleotide
ccactctcagttgcgcttc

SEQ ID NO: 1702 - DNA, 19 bp, Artificial Sequence
  Description of Artificial Sequence: Chemically synthesized oligonucleotide
gaagcgcaactgagagtgg

SEQ ID NO: 1703 - DNA, 19 bp, Artificial Sequence
  Description of Artificial Sequence: Chemically synthesized oligonucleotide
cactctcagttgcgcttct

SEQ ID NO: 1704 - DNA, 19 bp, Artificial Sequence
  Description of Artificial Sequence: Chemically synthesized oligonucleotide
agaagcgcaactgagagtg

SEQ ID NO: 1705 - DNA, 19 bp, Artificial Sequence
  Description of Artificial Sequence: Chemically synthesized oligonucleotide
actctcagttgcgcttctg

SEQ ID NO: 1706 - DNA, 19 bp, Artificial Sequence
  Description of Artificial Sequence: Chemically synthesized oligonucleotide
cagaagcgcaactgagagt

SEQ ID NO: 1707 - DNA, 19 bp, Artificial Sequence
  Description of Artificial Sequence: Chemically synthesized oligonucleotide
ctctcagttgcgcttctgg

SEQ ID NO: 1708 - DNA, 19 bp, Artificial Sequence
  Description of Artificial Sequence: Chemically synthesized oligonucleotide
ccagaagcgcaactgagag

SEQ ID NO: 1709 - DNA, 19 bp, Artificial Sequence
  Description of Artificial Sequence: Chemically synthesized oligonucleotide
tctcagttgcgcttctggc

SEQ ID NO: 1710 - DNA, 19 bp, Artificial Sequence
  Description of Artificial Sequence: Chemically synthesized oligonucleotide
gccagaagcgcaactgaga

SEQ ID NO: 1711 - DNA, 19 bp, Artificial Sequence
  Description of Artificial Sequence: Chemically synthesized oligonucleotide
ctcagttgcgcttctggcg

SEQ ID NO: 1712 - DNA, 19 bp, Artificial Sequence
  Description of Artificial Sequence: Chemically synthesized oligonucleotide
cgccagaagcgcaactgag

SEQ ID NO: 1713 - DNA, 19 bp, Artificial Sequence
  Description of Artificial Sequence: Chemically synthesized oligonucleotide
tcagttgcgcttctggcga

SEQ ID NO: 1714 - DNA, 19 bp, Artificial Sequence
  Description of Artificial Sequence: Chemically synthesized oligonucleotide
tcgccagaagcgcaactga

SEQ ID NO: 1715 - DNA, 19 bp, Artificial Sequence
  Description of Artificial Sequence: Chemically synthesized oligonucleotide
cagttgcgcttctggcgat

SEQ ID NO: 1716 - DNA, 19 bp, Artificial Sequence
  Description of Artificial Sequence: Chemically synthesized oligonucleotide
atcgccagaagcgcaactg

SEQ ID NO: 1717 - DNA, 19 bp, Artificial Sequence
  Description of Artificial Sequence: Chemically synthesized oligonucleotide
agttgcgcttctggcgatg

SEQ ID NO: 1718 - DNA, 19 bp, Artificial Sequence
  Description of Artificial Sequence: Chemically synthesized oligonucleotide
catcgccagaagcgcaact

SEQ ID NO: 1719 - DNA, 19 bp, Artificial Sequence
  Description of Artificial Sequence: Chemically synthesized oligonucleotide
gttgcgcttctggcgatgg

SEQ ID NO: 1720 - DNA, 19 bp, Artificial Sequence
  Description of Artificial Sequence: Chemically synthesized oligonucleotide
ccatcgccagaagcgcaac

SEQ ID NO: 1721 - DNA, 19 bp, Artificial Sequence
  Description of Artificial Sequence: Chemically synthesized oligonucleotide
ttgcgcttctggcgatggc

SEQ ID NO: 1722 - DNA, 19 bp, Artificial Sequence
  Description of Artificial Sequence: Chemically synthesized oligonucleotide
gccatcgccagaagcgcaa

SEQ ID NO: 1723 - DNA, 19 bp, Artificial Sequence
  Description of Artificial Sequence: Chemically synthesized oligonucleotide
tgcgcttctggcgatggcg

SEQ ID NO: 1724 - DNA, 19 bp, Artificial Sequence
  Description of Artificial Sequence: Chemically synthesized oligonucleotide
cgccatcgccagaagcgca

SEQ ID NO: 1725 - DNA, 19 bp, Artificial Sequence
  Description of Artificial Sequence: Chemically synthesized oligonucleotide
gcgcttctggcgatggcga

SEQ ID NO: 1726 - DNA, 19 bp, Artificial Sequence
  Description of Artificial Sequence: Chemically synthesized oligonucleotide
tcgccatcgccagaagcgc

SEQ ID NO: 1727 - DNA, 19 bp, Artificial Sequence
  Description of Artificial Sequence: Chemically synthesized oligonucleotide
cgcttctggcgatggcgat

SEQ ID NO: 1728 - DNA, 19 bp, Artificial Sequence
  Description of Artificial Sequence: Chemically synthesized oligonucleotide
atcgccatcgccagaagcg

SEQ ID NO: 1729 - DNA, 19 bp, Artificial Sequence
  Description of Artificial Sequence: Chemically synthesized oligonucleotide
gcttctggcgatggcgatc

SEQ ID NO: 1730 - DNA, 19 bp, Artificial Sequence
  Description of Artificial Sequence: Chemically synthesized oligonucleotide
gatcgccatcgccagaagc

SEQ ID NO: 1731 - DNA, 19 bp, Artificial Sequence
  Description of Artificial Sequence: Chemically synthesized oligonucleotide
cttctggcgatggcgatca

SEQ ID NO: 1732 - DNA, 19 bp, Artificial Sequence
  Description of Artificial Sequence: Chemically synthesized oligonucleotide
tgatcgccatcgccagaag

SEQ ID NO: 1733 - DNA, 19 bp, Artificial Sequence
  Description of Artificial Sequence: Chemically synthesized oligonucleotide
ttctggcgatggcgatcag

SEQ ID NO: 1734 - DNA, 19 bp, Artificial Sequence
  Description of Artificial Sequence: Chemically synthesized oligonucleotide
ctgatcgccatcgccagaa

SEQ ID NO: 1735 - DNA, 19 bp, Artificial Sequence
  Description of Artificial Sequence: Chemically synthesized oligonucleotide
tctggcgatggcgatcaga

SEQ ID NO: 1736 - DNA, 19 bp, Artificial Sequence
  Description of Artificial Sequence: Chemically synthesized oligonucleotide
tctgatcgccatcgccaga

SEQ ID NO: 1737 - DNA, 19 bp, Artificial Sequence
  Description of Artificial Sequence: Chemically synthesized oligonucleotide
ctggcgatggcgatcagag

SEQ ID NO: 1738 - DNA, 19 bp, Artificial Sequence
  Description of Artificial Sequence: Chemically synthesized oligonucleotide
ctctgatcgccatcgccag

SEQ ID NO: 1739 - DNA, 19 bp, Artificial Sequence
  Description of Artificial Sequence: Chemically synthesized oligonucleotide
tggcgatggcgatcagagg

SEQ ID NO: 1740 - DNA, 19 bp, Artificial Sequence
  Description of Artificial Sequence: Chemically synthesized oligonucleotide
cctctgatcgccatcgcca

SEQ ID NO: 1741 - DNA, 19 bp, Artificial Sequence
  Description of Artificial Sequence: Chemically synthesized oligonucleotide
ggcgatggcgatcagaggt

SEQ ID NO: 1742 - DNA, 19 bp, Artificial Sequence
  Description of Artificial Sequence: Chemically synthesized oligonucleotide
acctctgatcgccatcgcc

SEQ ID NO: 1743 - DNA, 19 bp, Artificial Sequence
  Description of Artificial Sequence: Chemically synthesized oligonucleotide
gcgatggcgatcagaggtc

SEQ ID NO: 1744 - DNA, 19 bp, Artificial Sequence
  Description of Artificial Sequence: Chemically synthesized oligonucleotide
gacctctgatcgccatcgc

SEQ ID NO: 1745 - DNA, 19 bp, Artificial Sequence
  Description of Artificial Sequence: Chemically synthesized oligonucleotide
cgatggcgatcagaggtcc

SEQ ID NO: 1746 - DNA, 19 bp, Artificial Sequence
  Description of Artificial Sequence: Chemically synthesized oligonucleotide
ggacctctgatcgccatcg

SEQ ID NO: 1747 - DNA, 19 bp, Artificial Sequence
  Description of Artificial Sequence: Chemically synthesized oligonucleotide
gatggcgatcagaggtcct

SEQ ID NO: 1748 - DNA, 19 bp, Artificial Sequence
  Description of Artificial Sequence: Chemically synthesized oligonucleotide
aggacctctgatcgccatc

SEQ ID NO: 1749 - DNA, 19 bp, Artificial Sequence
  Description of Artificial Sequence: Chemically synthesized oligonucleotide
atggcgatcagaggtcctg

SEQ ID NO: 1750 - DNA, 19 bp, Artificial Sequence
  Description of Artificial Sequence: Chemically synthesized oligonucleotide
caggacctctgatcgccat

SEQ ID NO: 1751 - DNA, 19 bp, Artificial Sequence
  Description of Artificial Sequence: Chemically synthesized oligonucleotide
tggcgatcagaggtcctgc

SEQ ID NO: 1752 - DNA, 19 bp, Artificial Sequence
  Description of Artificial Sequence: Chemically synthesized oligonucleotide
gcaggacctctgatcgcca

SEQ ID NO: 1753 - DNA, 19 bp, Artificial Sequence
  Description of Artificial Sequence: Chemically synthesized oligonucleotide
ggcgatcagaggtcctgct

SEQ ID NO: 1754 - DNA, 19 bp, Artificial Sequence
  Description of Artificial Sequence: Chemically synthesized oligonucleotide
agcaggacctctgatcgcc

SEQ ID NO: 1755 - DNA, 19 bp, Artificial Sequence
  Description of Artificial Sequence: Chemically synthesized oligonucleotide
gcgatcagaggtcctgctg

SEQ ID NO: 1756 - DNA, 19 bp, Artificial Sequence
  Description of Artificial Sequence: Chemically synthesized oligonucleotide
cagcaggacctctgatcgc

SEQ ID NO: 1757 - DNA, 19 bp, Artificial Sequence
  Description of Artificial Sequence: Chemically synthesized oligonucleotide
cgatcagaggtcctgctgc

SEQ ID NO: 1758 - DNA, 19 bp, Artificial Sequence
  Description of Artificial Sequence: Chemically synthesized oligonucleotide
gcagcaggacctctgatcg

SEQ ID NO: 1759 - DNA, 19 bp, Artificial Sequence
  Description of Artificial Sequence: Chemically synthesized oligonucleotide
gatcagaggtcctgctgcg

SEQ ID NO: 1760 - DNA, 19 bp, Artificial Sequence
  Description of Artificial Sequence: Chemically synthesized oligonucleotide
cgcagcaggacctctgatc

SEQ ID NO: 1761 - DNA, 19 bp, Artificial Sequence
  Description of Artificial Sequence: Chemically synthesized oligonucleotide
atcagaggtcctgctgcgc

SEQ ID NO: 1762 - DNA, 19 bp, Artificial Sequence
  Description of Artificial Sequence: Chemically synthesized oligonucleotide
gcgcagcaggacctctgat

SEQ ID NO: 1763 - DNA, 19 bp, Artificial Sequence
  Description of Artificial Sequence: Chemically synthesized oligonucleotide
tcagaggtcctgctgcgct

SEQ ID NO: 1764 - DNA, 19 bp, Artificial Sequence
  Description of Artificial Sequence: Chemically synthesized oligonucleotide
agcgcagcaggacctctga

SEQ ID NO: 1765 - DNA, 19 bp, Artificial Sequence
  Description of Artificial Sequence: Chemically synthesized oligonucleotide
cagaggtcctgctgcgctc

SEQ ID NO: 1766 - DNA, 19 bp, Artificial Sequence
  Description of Artificial Sequence: Chemically synthesized oligonucleotide
gagcgcagcaggacctctg

SEQ ID NO: 1767 - DNA, 19 bp, Artificial Sequence
  Description of Artificial Sequence: Chemically synthesized oligonucleotide
agaggtcctgctgcgctct

SEQ ID NO: 1768 - DNA, 19 bp, Artificial Sequence
  Description of Artificial Sequence: Chemically synthesized oligonucleotide
agagcgcagcaggacctct

SEQ ID NO: 1769 - DNA, 19 bp, Artificial Sequence
  Description of Artificial Sequence: Chemically synthesized oligonucleotide
gaggtcctgctgcgctctc

SEQ ID NO: 1770 - DNA, 19 bp, Artificial Sequence
  Description of Artificial Sequence: Chemically synthesized oligonucleotide
gagagcgcagcaggacctc

SEQ ID NO: 1771 - DNA, 19 bp, Artificial Sequence
  Description of Artificial Sequence: Chemically synthesized oligonucleotide
aggtcctgctgcgctctcc

SEQ ID NO: 1772 - DNA, 19 bp, Artificial Sequence
  Description of Artificial Sequence: Chemically synthesized oligonucleotide
ggagagcgcagcaggacct

SEQ ID NO: 1773 - DNA, 19 bp, Artificial Sequence
  Description of Artificial Sequence: Chemically synthesized oligonucleotide
ggtcctgctgcgctctccg

SEQ ID NO: 1774 - DNA, 19 bp, Artificial Sequence
  Description of Artificial Sequence: Chemically synthesized oligonucleotide
cggagagcgcagcaggacc

SEQ ID NO: 1775 - DNA, 19 bp, Artificial Sequence
  Description of Artificial Sequence: Chemically synthesized oligonucleotide
gtcctgctgcgctctccgc

SEQ ID NO: 1776 - DNA, 19 bp, Artificial Sequence
  Description of Artificial Sequence: Chemically synthesized oligonucleotide
gcggagagcgcagcaggac

SEQ ID NO: 1777 - DNA, 19 bp, Artificial Sequence
  Description of Artificial Sequence: Chemically synthesized oligonucleotide
tcctgctgcgctctccgcc

SEQ ID NO: 1778 - DNA, 19 bp, Artificial Sequence
  Description of Artificial Sequence: Chemically synthesized oligonucleotide
ggcggagagcgcagcagga

SEQ ID NO: 1779 - DNA, 19 bp, Artificial Sequence
  Description of Artificial Sequence: Chemically synthesized oligonucleotide
cctgctgcgctctccgccg

SEQ ID NO: 1780 - DNA, 19 bp, Artificial Sequence
  Description of Artificial Sequence: Chemically synthesized oligonucleotide
cggcggagagcgcagcagg

SEQ ID NO: 1781 - DNA, 19 bp, Artificial Sequence
  Description of Artificial Sequence: Chemically synthesized oligonucleotide
ctgctgcgctctccgccgc

SEQ ID NO: 1782 - DNA, 19 bp, Artificial Sequence
  Description of Artificial Sequence: Chemically synthesized oligonucleotide
gcggcggagagcgcagcag

SEQ ID NO: 1783 - DNA, 19 bp, Artificial Sequence
  Description of Artificial Sequence: Chemically synthesized oligonucleotide
tgctgcgctctccgccgcg

SEQ ID NO: 1784 - DNA, 19 bp, Artificial Sequence
  Description of Artificial Sequence: Chemically synthesized oligonucleotide
cgcggcggagagcgcagca

SEQ ID NO: 1785 - DNA, 19 bp, Artificial Sequence
  Description of Artificial Sequence: Chemically synthesized oligonucleotide
gctgcgctctccgccgcgc

SEQ ID NO: 1786 - DNA, 19 bp, Artificial Sequence
  Description of Artificial Sequence: Chemically synthesized oligonucleotide
gcgcggcggagagcgcagc

SEQ ID NO: 1787 - DNA, 19 bp, Artificial Sequence
  Description of Artificial Sequence: Chemically synthesized oligonucleotide
ctgcgctctccgccgcgct

SEQ ID NO: 1788 - DNA, 19 bp, Artificial Sequence
  Description of Artificial Sequence: Chemically synthesized oligonucleotide
agcgcggcggagagcgcag

SEQ ID NO: 1789 - DNA, 19 bp, Artificial Sequence
  Description of Artificial Sequence: Chemically synthesized oligonucleotide
tgcgctctccgccgcgctc

SEQ ID NO: 1790 - DNA, 19 bp, Artificial Sequence
  Description of Artificial Sequence: Chemically synthesized oligonucleotide
gagcgcggcggagagcgca

SEQ ID NO: 1791 - DNA, 19 bp, Artificial Sequence
  Description of Artificial Sequence: Chemically synthesized oligonucleotide
gcgctctccgccgcgctct

SEQ ID NO: 1792 - DNA, 19 bp, Artificial Sequence
  Description of Artificial Sequence: Chemically synthesized oligonucleotide
agagcgcggcggagagcgc

SEQ ID NO: 1793 - DNA, 19 bp, Artificial Sequence
  Description of Artificial Sequence: Chemically synthesized oligonucleotide
cgctctccgccgcgctcta

SEQ ID NO: 1794 - DNA, 19 bp, Artificial Sequence
  Description of Artificial Sequence: Chemically synthesized oligonucleotide
tagagcgcggcggagagcg

SEQ ID NO: 1795 - DNA, 19 bp, Artificial Sequence
  Description of Artificial Sequence: Chemically synthesized oligonucleotide
gctctccgccgcgctctac

SEQ ID NO: 1796 - DNA, 19 bp, Artificial Sequence
  Description of Artificial Sequence: Chemically synthesized oligonucleotide
gtagagcgcggcggagagc

SEQ ID NO: 1797 - DNA, 19 bp, Artificial Sequence
  Description of Artificial Sequence: Chemically synthesized oligonucleotide
ctctccgccgcgctctacc

SEQ ID NO: 1798 - DNA, 19 bp, Artificial Sequence
  Description of Artificial Sequence: Chemically synthesized oligonucleotide
ggtagagcgcggcggagag

SEQ ID NO: 1799 - DNA, 19 bp, Artificial Sequence
  Description of Artificial Sequence: Chemically synthesized oligonucleotide
tctccgccgcgctctacct

SEQ ID NO: 1800 - DNA, 19 bp, Artificial Sequence
  Description of Artificial Sequence: Chemically synthesized oligonucleotide
aggtagagcgcggcggaga

SEQ ID NO: 1801 - DNA, 19 bp, Artificial Sequence
  Description of Artificial Sequence: Chemically synthesized oligonucleotide
ctccgccgcgctctacctc

SEQ ID NO: 1802 - DNA, 19 bp, Artificial Sequence
  Description of Artificial Sequence: Chemically synthesized oligonucleotide
gaggtagagcgcggcggag

SEQ ID NO: 1803 - DNA, 19 bp, Artificial Sequence
  Description of Artificial Sequence: Chemically synthesized oligonucleotide
tccgccgcgctctacctcc

SEQ ID NO: 1804 - DNA, 19 bp, Artificial Sequence
  Description of Artificial Sequence: Chemically synthesized oligonucleotide
ggaggtagagcgcggcgga

SEQ ID NO: 1805 - DNA, 19 bp, Artificial Sequence
  Description of Artificial Sequence: Chemically synthesized oligonucleotide
ccgccgcgctctacctcca

SEQ ID NO: 1806 - DNA, 19 bp, Artificial Sequence
  Description of Artificial Sequence: Chemically synthesized oligonucleotide
tggaggtagagcgcggcgg

SEQ ID NO: 1807 - DNA, 19 bp, Artificial Sequence
  Description of Artificial Sequence: Chemically synthesized oligonucleotide
cgccgcgctctacctccat

SEQ ID NO: 1808 - DNA, 19 bp, Artificial Sequence
  Description of Artificial Sequence: Chemically synthesized oligonucleotide
atggaggtagagcgcggcg

SEQ ID NO: 1809 - DNA, 19 bp, Artificial Sequence
  Description of Artificial Sequence: Chemically synthesized oligonucleotide
gccgcgctctacctccatt

SEQ ID NO: 1810 - DNA, 19 bp, Artificial Sequence
  Description of Artificial Sequence: Chemically synthesized oligonucleotide
aatggaggtagagcgcggc

SEQ ID NO: 1811 - DNA, 19 bp, Artificial Sequence
  Description of Artificial Sequence: Chemically synthesized oligonucleotide
ccgcgctctacctccatta

SEQ ID NO: 1812 - DNA, 19 bp, Artificial Sequence
  Description of Artificial Sequence: Chemically synthesized oligonucleotide
taatggaggtagagcgcgg

SEQ ID NO: 1813 - DNA, 19 bp, Artificial Sequence
  Description of Artificial Sequence: Chemically synthesized oligonucleotide
cgcgctctacctccattag

SEQ ID NO: 1814 - DNA, 19 bp, Artificial Sequence
  Description of Artificial Sequence: Chemically synthesized oligonucleotide
ctaatggaggtagagcgcg

SEQ ID NO: 1815 - DNA, 19 bp, Artificial Sequence
  Description of Artificial Sequence: Chemically synthesized oligonucleotide
gcgctctacctccattagc

SEQ ID NO: 1816 - DNA, 19 bp, Artificial Sequence
  Description of Artificial Sequence: Chemically synthesized oligonucleotide
gctaatggaggtagagcgc

SEQ ID NO: 1817 - DNA, 19 bp, Artificial Sequence
  Description of Artificial Sequence: Chemically synthesized oligonucleotide
cgctctacctccattagcc

SEQ ID NO: 1818 - DNA, 19 bp, Artificial Sequence
  Description of Artificial Sequence: Chemically synthesized oligonucleotide
ggctaatggaggtagagcg

SEQ ID NO: 1819 - DNA, 19 bp, Artificial Sequence
  Description of Artificial Sequence: Chemically synthesized oligonucleotide
gctctacctccattagccg

SEQ ID NO: 1820 - DNA, 19 bp, Artificial Sequence
  Description of Artificial Sequence: Chemically synthesized oligonucleotide
cggctaatggaggtagagc

SEQ ID NO: 1821 - DNA, 19 bp, Artificial Sequence
  Description of Artificial Sequence: Chemically synthesized oligonucleotide
ctctacctccattagccgc

SEQ ID NO: 1822 - DNA, 19 bp, Artificial Sequence
  Description of Artificial Sequence: Chemically synthesized oligonucleotide
gcggctaatggaggtagag

SEQ ID NO: 1823 - DNA, 19 bp, Artificial Sequence
  Description of Artificial Sequence: Chemically synthesized oligonucleotide
tctacctccattagccgcg

SEQ ID NO: 1824 - DNA, 19 bp, Artificial Sequence
  Description of Artificial Sequence: Chemically synthesized oligonucleotide
cgcggctaatggaggtaga

SEQ ID NO: 1825 - DNA, 19 bp, Artificial Sequence
  Description of Artificial Sequence: Chemically synthesized oligonucleotide
ctacctccattagccgcgc

SEQ ID NO: 1826 - DNA, 19 bp, Artificial Sequence
  Description of Artificial Sequence: Chemically synthesized oligonucleotide
gcgcggctaatggaggtag

SEQ ID NO: 1827 - DNA, 19 bp, Artificial Sequence
  Description of Artificial Sequence: Chemically synthesized oligonucleotide
tacctccattagccgcgct

SEQ ID NO: 1828 - DNA, 19 bp, Artificial Sequence
  Description of Artificial Sequence: Chemically synthesized oligonucleotide
agcgcggctaatggaggta

SEQ ID NO: 1829 - DNA, 19 bp, Artificial Sequence
  Description of Artificial Sequence: Chemically synthesized oligonucleotide
acctccattagccgcgctg

SEQ ID NO: 1830 - DNA, 19 bp, Artificial Sequence
  Description of Artificial Sequence: Chemically synthesized oligonucleotide
cagcgcggctaatggaggt

SEQ ID NO: 1831 - DNA, 19 bp, Artificial Sequence
  Description of Artificial Sequence: Chemically synthesized oligonucleotide
cctccattagccgcgctgc

SEQ ID NO: 1832 - DNA, 19 bp, Artificial Sequence
  Description of Artificial Sequence: Chemically synthesized oligonucleotide
gcagcgcggctaatggagg

SEQ ID NO: 1833 - DNA, 19 bp, Artificial Sequence
  Description of Artificial Sequence: Chemically synthesized oligonucleotide
ctccattagccgcgctgcg

SEQ ID NO: 1834 - DNA, 19 bp, Artificial Sequence
  Description of Artificial Sequence: Chemically synthesized oligonucleotide
cgcagcgcggctaatggag

SEQ ID NO: 1835 - DNA, 19 bp, Artificial Sequence
  Description of Artificial Sequence: Chemically synthesized oligonucleotide
tccattagccgcgctgcgc

SEQ ID NO: 1836 - DNA, 19 bp, Artificial Sequence
  Description of Artificial Sequence: Chemically synthesized oligonucleotide
gcgcagcgcggctaatgga

SEQ ID NO: 1837 - DNA, 19 bp, Artificial Sequence
  Description of Artificial Sequence: Chemically synthesized oligonucleotide
ccattagccgcgctgcgcg

SEQ ID NO: 1838 - DNA, 19 bp, Artificial Sequence
  Description of Artificial Sequence: Chemically synthesized oligonucleotide
cgcgcagcgcggctaatgg

SEQ ID NO: 1839 - DNA, 19 bp, Artificial Sequence
  Description of Artificial Sequence: Chemically synthesized oligonucleotide
cattagccgcgctgcgcgg

SEQ ID NO: 1840 - DNA, 19 bp, Artificial Sequence
  Description of Artificial Sequence: Chemically synthesized oligonucleotide
ccgcgcagcgcggctaatg

SEQ ID NO: 1841 - DNA, 19 bp, Artificial Sequence
  Description of Artificial Sequence: Chemically synthesized oligonucleotide
attagccgcgctgcgcggt

SEQ ID NO: 1842 - DNA, 19 bp, Artificial Sequence
  Description of Artificial Sequence: Chemically synthesized oligonucleotide
accgcgcagcgcggctaat

SEQ ID NO: 1843 - DNA, 19 bp, Artificial Sequence
  Description of Artificial Sequence: Chemically synthesized oligonucleotide
ttagccgcgctgcgcggtg

SEQ ID NO: 1844 - DNA, 19 bp, Artificial Sequence
  Description of Artificial Sequence: Chemically synthesized oligonucleotide
caccgcgcagcgcggctaa

SEQ ID NO: 1845 - DNA, 19 bp, Artificial Sequence
  Description of Artificial Sequence: Chemically synthesized oligonucleotide
tagccgcgctgcgcggtgc

SEQ ID NO: 1846 - DNA, 19 bp, Artificial Sequence
  Description of Artificial Sequence: Chemically synthesized oligonucleotide
gcaccgcgcagcgcggcta

SEQ ID NO: 1847 - DNA, 19 bp, Artificial Sequence
  Description of Artificial Sequence: Chemically synthesized oligonucleotide
agccgcgctgcgcggtgct

SEQ ID NO: 1848 - DNA, 19 bp, Artificial Sequence
  Description of Artificial Sequence: Chemically synthesized oligonucleotide
agcaccgcgcagcgcggct

SEQ ID NO: 1849 - DNA, 19 bp, Artificial Sequence
  Description of Artificial Sequence: Chemically synthesized oligonucleotide
gccgcgctgcgcggtgctg

SEQ ID NO: 1850 - DNA, 19 bp, Artificial Sequence
  Description of Artificial Sequence: Chemically synthesized oligonucleotide
cagcaccgcgcagcgcggc

SEQ ID NO: 1851 - DNA, 19 bp, Artificial Sequence
  Description of Artificial Sequence: Chemically synthesized oligonucleotide
ccgcgctgcgcggtgctgc

SEQ ID NO: 1852 - DNA, 19 bp, Artificial Sequence
  Description of Artificial Sequence: Chemically synthesized oligonucleotide
gcagcaccgcgcagcgcgg

SEQ ID NO: 1853 - DNA, 19 bp, Artificial Sequence
  Description of Artificial Sequence: Chemically synthesized oligonucleotide
cgcgctgcgcggtgctgcg

SEQ ID NO: 1854 - DNA, 19 bp, Artificial Sequence
  Description of Artificial Sequence: Chemically synthesized oligonucleotide
cgcagcaccgcgcagcgcg

SEQ ID NO: 1855 - DNA, 19 bp, Artificial Sequence
  Description of Artificial Sequence: Chemically synthesized oligonucleotide
gcgctgcgcggtgctgcgc

SEQ ID NO: 1856 - DNA, 19 bp, Artificial Sequence
  Description of Artificial Sequence: Chemically synthesized oligonucleotide
gcgcagcaccgcgcagcgc

SEQ ID NO: 1857 - DNA, 19 bp, Artificial Sequence
  Description of Artificial Sequence: Chemically synthesized oligonucleotide
cgctgcgcggtgctgcgcc

SEQ ID NO: 1858 - DNA, 19 bp, Artificial Sequence
  Description of Artificial Sequence: Chemically synthesized oligonucleotide
ggcgcagcaccgcgcagcg

SEQ ID NO: 1859 - DNA, 19 bp, Artificial Sequence
  Description of Artificial Sequence: Chemically synthesized oligonucleotide
gctgcgcggtgctgcgccc

SEQ ID NO: 1860 - DNA, 19 bp, Artificial Sequence
  Description of Artificial Sequence: Chemically synthesized oligonucleotide
gggcgcagcaccgcgcagc

SEQ ID NO: 1861 - DNA, 19 bp, Artificial Sequence
  Description of Artificial Sequence: Chemically synthesized oligonucleotide
ctgcgcggtgctgcgccct

SEQ ID NO: 1862 - DNA, 19 bp, Artificial Sequence
  Description of Artificial Sequence: Chemically synthesized oligonucleotide
agggcgcagcaccgcgcag

SEQ ID NO: 1863 - DNA, 19 bp, Artificial Sequence
  Description of Artificial Sequence: Chemically synthesized oligonucleotide
tgcgcggtgctgcgccctc

SEQ ID NO: 1864 - DNA, 19 bp, Artificial Sequence
  Description of Artificial Sequence: Chemically synthesized oligonucleotide
gagggcgcagcaccgcgca

SEQ ID NO: 1865 - DNA, 19 bp, Artificial Sequence
  Description of Artificial Sequence: Chemically synthesized oligonucleotide
gcgcggtgctgcgccctcg

SEQ ID NO: 1866 - DNA, 19 bp, Artificial Sequence
  Description of Artificial Sequence: Chemically synthesized oligonucleotide
cgagggcgcagcaccgcgc

SEQ ID NO: 1867 - DNA, 19 bp, Artificial Sequence
  Description of Artificial Sequence: Chemically synthesized oligonucleotide
cgcggtgctgcgccctcgc

SEQ ID NO: 1868 - DNA, 19 bp, Artificial Sequence
  Description of Artificial Sequence: Chemically synthesized oligonucleotide
gcgagggcgcagcaccgcg

SEQ ID NO: 1869 - DNA, 19 bp, Artificial Sequence
  Description of Artificial Sequence: Chemically synthesized oligonucleotide
gcggtgctgcgccctcgcc

SEQ ID NO: 1870 - DNA, 19 bp, Artificial Sequence
  Description of Artificial Sequence: Chemically synthesized oligonucleotide
ggcgagggcgcagcaccgc

SEQ ID NO: 1871 - DNA, 19 bp, Artificial Sequence
  Description of Artificial Sequence: Chemically synthesized oligonucleotide
cggtgctgcgccctcgccg

SEQ ID NO: 1872 - DNA, 19 bp, Artificial Sequence
  Description of Artificial Sequence: Chemically synthesized oligonucleotide
cggcgagggcgcagcaccg

SEQ ID NO: 1873 - DNA, 19 bp, Artificial Sequence
  Description of Artificial Sequence: Chemically synthesized oligonucleotide
ggtgctgcgccctcgccgg

SEQ ID NO: 1874 - DNA, 19 bp, Artificial Sequence
  Description of Artificial Sequence: Chemically synthesized oligonucleotide
ccggcgagggcgcagcacc

SEQ ID NO: 1875 - DNA, 19 bp, Artificial Sequence
  Description of Artificial Sequence: Chemically synthesized oligonucleotide
gtgctgcgccctcgccggt

SEQ ID NO: 1876 - DNA, 19 bp, Artificial Sequence
  Description of Artificial Sequence: Chemically synthesized oligonucleotide
accggcgagggcgcagcac

SEQ ID NO: 1877 - DNA, 19 bp, Artificial Sequence
  Description of Artificial Sequence: Chemically synthesized oligonucleotide
tgctgcgccctcgccggtg

SEQ ID NO: 1878 - DNA, 19 bp, Artificial Sequence
  Description of Artificial Sequence: Chemically synthesized oligonucleotide
caccggcgagggcgcagca

SEQ ID NO: 1879 - DNA, 19 bp, Artificial Sequence
  Description of Artificial Sequence: Chemically synthesized oligonucleotide
gctgcgccctcgccggtgc

SEQ ID NO: 1880 - DNA, 19 bp, Artificial Sequence
  Description of Artificial Sequence: Chemically synthesized oligonucleotide
gcaccggcgagggcgcagc

SEQ ID NO: 1881 - DNA, 19 bp, Artificial Sequence
  Description of Artificial Sequence: Chemically synthesized oligonucleotide
ctgcgccctcgccggtgcc

SEQ ID NO: 1882 - DNA, 19 bp, Artificial Sequence
  Description of Artificial Sequence: Chemically synthesized oligonucleotide
ggcaccggcgagggcgcag

SEQ ID NO: 1883 - DNA, 19 bp, Artificial Sequence
  Description of Artificial Sequence: Chemically synthesized oligonucleotide
tgcgccctcgccggtgcct

SEQ ID NO: 1884 - DNA, 19 bp, Artificial Sequence
  Description of Artificial Sequence: Chemically synthesized oligonucleotide
aggcaccggcgagggcgca

SEQ ID NO: 1885 - DNA, 19 bp, Artificial Sequence
  Description of Artificial Sequence: Chemically synthesized oligonucleotide
gcgccctcgccggtgcctc

SEQ ID NO: 1886 - DNA, 19 bp, Artificial Sequence
  Description of Artificial Sequence: Chemically synthesized oligonucleotide
gaggcaccggcgagggcgc

SEQ ID NO: 1887 - DNA, 19 bp, Artificial Sequence
  Description of Artificial Sequence: Chemically synthesized oligonucleotide
cgccctcgccggtgcctct

SEQ ID NO: 1888 - DNA, 19 bp, Artificial Sequence
  Description of Artificial Sequence: Chemically synthesized oligonucleotide
agaggcaccggcgagggcg

SEQ ID NO: 1889 - DNA, 19 bp, Artificial Sequence
  Description of Artificial Sequence: Chemically synthesized oligonucleotide
gccctcgccggtgcctctc

SEQ ID NO: 1890 - DNA, 19 bp, Artificial Sequence
  Description of Artificial Sequence: Chemically synthesized oligonucleotide
gagaggcaccggcgagggc

SEQ ID NO: 1891 - DNA, 19 bp, Artificial Sequence
  Description of Artificial Sequence: Chemically synthesized oligonucleotide
ccctcgccggtgcctctct

SEQ ID NO: 1892 - DNA, 19 bp, Artificial Sequence
  Description of Artificial Sequence: Chemically synthesized oligonucleotide
agagaggcaccggcgaggg

SEQ ID NO: 1893 - DNA, 19 bp, Artificial Sequence
  Description of Artificial Sequence: Chemically synthesized oligonucleotide
cctcgccggtgcctctctc

SEQ ID NO: 1894 - DNA, 19 bp, Artificial Sequence
  Description of Artificial Sequence: Chemically synthesized oligonucleotide
gagagaggcaccggcgagg

SEQ ID NO: 1895 - DNA, 19 bp, Artificial Sequence
  Description of Artificial Sequence: Chemically synthesized oligonucleotide
ctcgccggtgcctctctcc

SEQ ID NO: 1896 - DNA, 19 bp, Artificial Sequence
  Description of Artificial Sequence: Chemically synthesized oligonucleotide
ggagagaggcaccggcgag

SEQ ID NO: 1897 - DNA, 19 bp, Artificial Sequence
  Description of Artificial Sequence: Chemically synthesized oligonucleotide
tcgccggtgcctctctcct

SEQ ID NO: 1898 - DNA, 19 bp, Artificial Sequence
  Description of Artificial Sequence: Chemically synthesized oligonucleotide
aggagagaggcaccggcga

SEQ ID NO: 1899 - DNA, 19 bp, Artificial Sequence
  Description of Artificial Sequence: Chemically synthesized oligonucleotide
cgccggtgcctctctcctg

SEQ ID NO: 1900 - DNA, 19 bp, Artificial Sequence
  Description of Artificial Sequence: Chemically synthesized oligonucleotide
caggagagaggcaccggcg

SEQ ID NO: 1901 - DNA, 19 bp, Artificial Sequence
  Description of Artificial Sequence: Chemically synthesized oligonucleotide
gccggtgcctctctcctgg

SEQ ID NO: 1902 - DNA, 19 bp, Artificial Sequence
  Description of Artificial Sequence: Chemically synthesized oligonucleotide
ccaggagagaggcaccggc

SEQ ID NO: 1903 - DNA, 19 bp, Artificial Sequence
  Description of Artificial Sequence: Chemically synthesized oligonucleotide
ccggtgcctctctcctggg

SEQ ID NO: 1904 - DNA, 19 bp, Artificial Sequence
  Description of Artificial Sequence: Chemically synthesized oligonucleotide
cccaggagagaggcaccgg

SEQ ID NO: 1905 - DNA, 19 bp, Artificial Sequence
  Description of Artificial Sequence: Chemically synthesized oligonucleotide
cggtgcctctctcctgggt

SEQ ID NO: 1906 - DNA, 19 bp, Artificial Sequence
  Description of Artificial Sequence: Chemically synthesized oligonucleotide
acccaggagagaggcaccg

SEQ ID NO: 1907 - DNA, 19 bp, Artificial Sequence
  Description of Artificial Sequence: Chemically synthesized oligonucleotide
ggtgcctctctcctgggtc

SEQ ID NO: 1908 - DNA, 19 bp, Artificial Sequence
  Description of Artificial Sequence: Chemically synthesized oligonucleotide
gacccaggagagaggcacc

SEQ ID NO: 1909 - DNA, 19 bp, Artificial Sequence
  Description of Artificial Sequence: Chemically synthesized oligonucleotide
gtgcctctctcctgggtcc

SEQ ID NO: 1910 - DNA, 19 bp, Artificial Sequence
  Description of Artificial Sequence: Chemically synthesized oligonucleotide
ggacccaggagagaggcac

SEQ ID NO: 1911 - DNA, 19 bp, Artificial Sequence
  Description of Artificial Sequence: Chemically synthesized oligonucleotide
tgcctctctcctgggtccc

SEQ ID NO: 1912 - DNA, 19 bp, Artificial Sequence
  Description of Artificial Sequence: Chemically synthesized oligonucleotide
gggacccaggagagaggca

SEQ ID NO: 1913 - DNA, 19 bp, Artificial Sequence
  Description of Artificial Sequence: Chemically synthesized oligonucleotide
gcctctctcctgggtccca

SEQ ID NO: 1914 - DNA, 19 bp, Artificial Sequence
  Description of Artificial Sequence: Chemically synthesized oligonucleotide
tgggacccaggagagaggc

SEQ ID NO: 1915 - DNA, 19 bp, Artificial Sequence
  Description of Artificial Sequence: Chemically synthesized oligonucleotide
cctctctcctgggtcccag

SEQ ID NO: 1916 - DNA, 19 bp, Artificial Sequence
  Description of Artificial Sequence: Chemically synthesized oligonucleotide
ctgggacccaggagagagg

SEQ ID NO: 1917 - DNA, 19 bp, Artificial Sequence
  Description of Artificial Sequence: Chemically synthesized oligonucleotide
ctctctcctgggtcccagg

SEQ ID NO: 1918 - DNA, 19 bp, Artificial Sequence
  Description of Artificial Sequence: Chemically synthesized oligonucleotide
cctgggacccaggagagag

SEQ ID NO: 1919 - DNA, 19 bp, Artificial Sequence
  Description of Artificial Sequence: Chemically synthesized oligonucleotide
tctctcctgggtcccagga

SEQ ID NO: 1920 - DNA, 19 bp, Artificial Sequence
  Description of Artificial Sequence: Chemically synthesized oligonucleotide
tcctgggacccaggagaga

SEQ ID NO: 1921 - DNA, 19 bp, Artificial Sequence
  Description of Artificial Sequence: Chemically synthesized oligonucleotide
ctctcctgggtcccaggat

SEQ ID NO: 1922 - DNA, 19 bp, Artificial Sequence
  Description of Artificial Sequence: Chemically synthesized oligonucleotide
atcctgggacccaggagag

SEQ ID NO: 1923 - DNA, 19 bp, Artificial Sequence
  Description of Artificial Sequence: Chemically synthesized oligonucleotide
tctcctgggtcccaggatc

SEQ ID NO: 1924 - DNA, 19 bp, Artificial Sequence
  Description of Artificial Sequence: Chemically synthesized oligonucleotide
gatcctgggacccaggaga

SEQ ID NO: 1925 - DNA, 19 bp, Artificial Sequence
  Description of Artificial Sequence: Chemically synthesized oligonucleotide
ctcctgggtcccaggatcg

SEQ ID NO: 1926 - DNA, 19 bp, Artificial Sequence
  Description of Artificial Sequence: Chemically synthesized oligonucleotide
cgatcctgggacccaggag

SEQ ID NO: 1927 - DNA, 19 bp, Artificial Sequence
  Description of Artificial Sequence: Chemically synthesized oligonucleotide
tcctgggtcccaggatcgg

SEQ ID NO: 1928 - DNA, 19 bp, Artificial Sequence
  Description of Artificial Sequence: Chemically synthesized oligonucleotide
ccgatcctgggacccagga

SEQ ID NO: 1929 - DNA, 19 bp, Artificial Sequence
  Description of Artificial Sequence: Chemically synthesized oligonucleotide
cctgggtcccaggatcggc

SEQ ID NO: 1930 - DNA, 19 bp, Artificial Sequence
  Description of Artificial Sequence: Chemically synthesized oligonucleotide
gccgatcctgggacccagg

SEQ ID NO: 1931 - DNA, 19 bp, Artificial Sequence
  Description of Artificial Sequence: Chemically synthesized oligonucleotide
ctgggtcccaggatcggcc

SEQ ID NO: 1932 - DNA, 19 bp, Artificial Sequence
  Description of Artificial Sequence: Chemically synthesized oligonucleotide
ggccgatcctgggacccag

SEQ ID NO: 1933 - DNA, 19 bp, Artificial Sequence
  Description of Artificial Sequence: Chemically synthesized oligonucleotide
tgggtcccaggatcggccc

SEQ ID NO: 1934 - DNA, 19 bp, Artificial Sequence
  Description of Artificial Sequence: Chemically synthesized oligonucleotide
gggccgatcctgggaccca

SEQ ID NO: 1935 - DNA, 19 bp, Artificial Sequence
  Description of Artificial Sequence: Chemically synthesized oligonucleotide
gggtcccaggatcggcccc

SEQ ID NO: 1936 - DNA, 19 bp, Artificial Sequence
  Description of Artificial Sequence: Chemically synthesized oligonucleotide
ggggccgatcctgggaccc

SEQ ID NO: 1937 - DNA, 19 bp, Artificial Sequence
  Description of Artificial Sequence: Chemically synthesized oligonucleotide
ggtcccaggatcggccccc

SEQ ID NO: 1938 - DNA, 19 bp, Artificial Sequence
  Description of Artificial Sequence: Chemically synthesized oligonucleotide
gggggccgatcctgggacc

SEQ ID NO: 1939 - DNA, 19 bp, Artificial Sequence
  Description of Artificial Sequence: Chemically synthesized oligonucleotide
gtcccaggatcggccccca

SEQ ID NO: 1940 - DNA, 19 bp, Artificial Sequence
  Description of Artificial Sequence: Chemically synthesized oligonucleotide
tgggggccgatcctgggac

SEQ ID NO: 1941 - DNA, 19 bp, Artificial Sequence
  Description of Artificial Sequence: Chemically synthesized oligonucleotide
tcccaggatcggcccccac

SEQ ID NO: 1942 - DNA, 19 bp, Artificial Sequence
  Description of Artificial Sequence: Chemically synthesized oligonucleotide
gtgggggccgatcctggga

SEQ ID NO: 1943 - DNA, 19 bp, Artificial Sequence
  Description of Artificial Sequence: Chemically synthesized oligonucleotide
cccaggatcggcccccacc

SEQ ID NO: 1944 - DNA, 19 bp, Artificial Sequence
  Description of Artificial Sequence: Chemically synthesized oligonucleotide
ggtgggggccgatcctggg

SEQ ID NO: 1945 - DNA, 19 bp, Artificial Sequence
  Description of Artificial Sequence: Chemically synthesized oligonucleotide
ccaggatcggcccccacca

SEQ ID NO: 1946 - DNA, 19 bp, Artificial Sequence
  Description of Artificial Sequence: Chemically synthesized oligonucleotide
tggtgggggccgatcctgg

SEQ ID NO: 1947 - DNA, 19 bp, Artificial Sequence
  Description of Artificial Sequence: Chemically synthesized oligonucleotide
caggatcggcccccaccat

SEQ ID NO: 1948 - DNA, 19 bp, Artificial Sequence
  Description of Artificial Sequence: Chemically synthesized oligonucleotide
atggtgggggccgatcctg

SEQ ID NO: 1949 - DNA, 19 bp, Artificial Sequence
  Description of Artificial Sequence: Chemically synthesized oligonucleotide
aggatcggcccccaccatc

SEQ ID NO: 1950 - DNA, 19 bp, Artificial Sequence
  Description of Artificial Sequence: Chemically synthesized oligonucleotide
gatggtgggggccgatcct

SEQ ID NO: 1951 - DNA, 19 bp, Artificial Sequence
  Description of Artificial Sequence: Chemically synthesized oligonucleotide
ggatcggcccccaccatcc

SEQ ID NO: 1952 - DNA, 19 bp, Artificial Sequence
  Description of Artificial Sequence: Chemically synthesized oligonucleotide
ggatggtgggggccgatcc

SEQ ID NO: 1953 - DNA, 19 bp, Artificial Sequence
  Description of Artificial Sequence: Chemically synthesized oligonucleotide
gatcggcccccaccatcca

SEQ ID NO: 1954 - DNA, 19 bp, Artificial Sequence
  Description of Artificial Sequence: Chemically synthesized oligonucleotide
tggatggtgggggccgatc

SEQ ID NO: 1955 - DNA, 19 bp, Artificial Sequence
  Description of Artificial Sequence: Chemically synthesized oligonucleotide
atcggcccccaccatccag

SEQ ID NO: 1956 - DNA, 19 bp, Artificial Sequence
  Description of Artificial Sequence: Chemically synthesized oligonucleotide
ctggatggtgggggccgat

SEQ ID NO: 1957 - DNA, 19 bp, Artificial Sequence
  Description of Artificial Sequence: Chemically synthesized oligonucleotide
tcggcccccaccatccagg

SEQ ID NO: 1958 - DNA, 19 bp, Artificial Sequence
  Description of Artificial Sequence: Chemically synthesized oligonucleotide
cctggatggtgggggccga

SEQ ID NO: 1959 - DNA, 19 bp, Artificial Sequence
  Description of Artificial Sequence: Chemically synthesized oligonucleotide
cggcccccaccatccaggc

SEQ ID NO: 1960 - DNA, 19 bp, Artificial Sequence
  Description of Artificial Sequence: Chemically synthesized oligonucleotide
gcctggatggtgggggccg

SEQ ID NO: 1961 - DNA, 19 bp, Artificial Sequence
  Description of Artificial Sequence: Chemically synthesized oligonucleotide
ggcccccaccatccaggca

SEQ ID NO: 1962 - DNA, 19 bp, Artificial Sequence
  Description of Artificial Sequence: Chemically synthesized oligonucleotide
tgcctggatggtgggggcc

SEQ ID NO: 1963 - DNA, 19 bp, Artificial Sequence
  Description of Artificial Sequence: Chemically synthesized oligonucleotide
gcccccaccatccaggcac

SEQ ID NO: 1964 - DNA, 19 bp, Artificial Sequence
  Description of Artificial Sequence: Chemically synthesized oligonucleotide
gtgcctggatggtgggggc

SEQ ID NO: 1965 - DNA, 19 bp, Artificial Sequence
  Description of Artificial Sequence: Chemically synthesized oligonucleotide
cccccaccatccaggcacg

SEQ ID NO: 1966 - DNA, 19 bp, Artificial Sequence
  Description of Artificial Sequence: Chemically synthesized oligonucleotide
cgtgcctggatggtggggg

SEQ ID NO: 1967 - DNA, 19 bp, Artificial Sequence
  Description of Artificial Sequence: Chemically synthesized oligonucleotide
ccccaccatccaggcacga

SEQ ID NO: 1968 - DNA, 19 bp, Artificial Sequence
  Description of Artificial Sequence: Chemically synthesized oligonucleotide
tcgtgcctggatggtgggg

SEQ ID NO: 1969 - DNA, 19 bp, Artificial Sequence
  Description of Artificial Sequence: Chemically synthesized oligonucleotide
cccaccatccaggcacgac

SEQ ID NO: 1970 - DNA, 19 bp, Artificial Sequence
  Description of Artificial Sequence: Chemically synthesized oligonucleotide
gtcgtgcctggatggtggg

SEQ ID NO: 1971 - DNA, 19 bp, Artificial Sequence
  Description of Artificial Sequence: Chemically synthesized oligonucleotide
ccaccatccaggcacgacc

SEQ ID NO: 1972 - DNA, 19 bp, Artificial Sequence
  Description of Artificial Sequence: Chemically synthesized oligonucleotide
ggtcgtgcctggatggtgg

SEQ ID NO: 1973 - DNA, 19 bp, Artificial Sequence
  Description of Artificial Sequence: Chemically synthesized oligonucleotide
caccatccaggcacgaccc

SEQ ID NO: 1974 - DNA, 19 bp, Artificial Sequence
  Description of Artificial Sequence: Chemically synthesized oligonucleotide
gggtcgtgcctggatggtg

SEQ ID NO: 1975 - DNA, 19 bp, Artificial Sequence
  Description of Artificial Sequence: Chemically synthesized oligonucleotide
accatccaggcacgacccc

SEQ ID NO: 1976 - DNA, 19 bp, Artificial Sequence
  Description of Artificial Sequence: Chemically synthesized oligonucleotide
ggggtcgtgcctggatggt

SEQ ID NO: 1977 - DNA, 19 bp, Artificial Sequence
  Description of Artificial Sequence: Chemically synthesized oligonucleotide
ccatccaggcacgaccccc

SEQ ID NO: 1978 - DNA, 19 bp, Artificial Sequence
  Description of Artificial Sequence: Chemically synthesized oligonucleotide
gggggtcgtgcctggatgg

SEQ ID NO: 1979 - DNA, 19 bp, Artificial Sequence
  Description of Artificial Sequence: Chemically synthesized oligonucleotide
catccaggcacgaccccct

SEQ ID NO: 1980 - DNA, 19 bp, Artificial Sequence
  Description of Artificial Sequence: Chemically synthesized oligonucleotide
agggggtcgtgcctggatg

SEQ ID NO: 1981 - DNA, 19 bp, Artificial Sequence
  Description of Artificial Sequence: Chemically synthesized oligonucleotide
atccaggcacgaccccctt

SEQ ID NO: 1982 - DNA, 19 bp, Artificial Sequence
  Description of Artificial Sequence: Chemically synthesized oligonucleotide
aagggggtcgtgcctggat

SEQ ID NO: 1983 - DNA, 19 bp, Artificial Sequence
  Description of Artificial Sequence: Chemically synthesized oligonucleotide
tccaggcacgacccccttc

SEQ ID NO: 1984 - DNA, 19 bp, Artificial Sequence
  Description of Artificial Sequence: Chemically synthesized oligonucleotide
gaagggggtcgtgcctgga

SEQ ID NO: 1985 - DNA, 19 bp, Artificial Sequence
  Description of Artificial Sequence: Chemically synthesized oligonucleotide
ccaggcacgacccccttcc

SEQ ID NO: 1986 - DNA, 19 bp, Artificial Sequence
  Description of Artificial Sequence: Chemically synthesized oligonucleotide
ggaagggggtcgtgcctgg

SEQ ID NO: 1987 - DNA, 19 bp, Artificial Sequence
  Description of Artificial Sequence: Chemically synthesized oligonucleotide
caggcacgacccccttccc

SEQ ID NO: 1988 - DNA, 19 bp, Artificial Sequence
  Description of Artificial Sequence: Chemically synthesized oligonucleotide
gggaagggggtcgtgcctg

SEQ ID NO: 1989 - DNA, 19 bp, Artificial Sequence
  Description of Artificial Sequence: Chemically synthesized oligonucleotide
aggcacgacccccttcccc

SEQ ID NO: 1990 - DNA, 19 bp, Artificial Sequence
  Description of Artificial Sequence: Chemically synthesized oligonucleotide
ggggaagggggtcgtgcct

SEQ ID NO: 1991 - DNA, 19 bp, Artificial Sequence
  Description of Artificial Sequence: Chemically synthesized oligonucleotide
ggcacgacccccttccccg

SEQ ID NO: 1992 - DNA, 19 bp, Artificial Sequence
  Description of Artificial Sequence: Chemically synthesized oligonucleotide
cggggaagggggtcgtgcc

SEQ ID NO: 1993 - DNA, 19 bp, Artificial Sequence
  Description of Artificial Sequence: Chemically synthesized oligonucleotide
gcacgacccccttccccgg

SEQ ID NO: 1994 - DNA, 19 bp, Artificial Sequence
  Description of Artificial Sequence: Chemically synthesized oligonucleotide
ccggggaagggggtcgtgc

SEQ ID NO: 1995 - DNA, 19 bp, Artificial Sequence
  Description of Artificial Sequence: Chemically synthesized oligonucleotide
cacgacccccttccccggc

SEQ ID NO: 1996 - DNA, 19 bp, Artificial Sequence
  Description of Artificial Sequence: Chemically synthesized oligonucleotide
gccggggaagggggtcgtg

SEQ ID NO: 1997 - DNA, 19 bp, Artificial Sequence
  Description of Artificial Sequence: Chemically synthesized oligonucleotide
acgacccccttccccggcc

SEQ ID NO: 1998 - DNA, 19 bp, Artificial Sequence
  Description of Artificial Sequence: Chemically synthesized oligonucleotide
ggccggggaagggggtcgt

SEQ ID NO: 1999 - DNA, 19 bp, Artificial Sequence
  Description of Artificial Sequence: Chemically synthesized oligonucleotide
cgacccccttccccggccc

SEQ ID NO: 2000 - DNA, 19 bp, Artificial Sequence
  Description of Artificial Sequence: Chemically synthesized oligonucleotide
gggccggggaagggggtcg

SEQ ID NO: 2001 - DNA, 19 bp, Artificial Sequence
  Description of Artificial Sequence: Chemically synthesized oligonucleotide
gacccccttccccggcccc

SEQ ID NO: 2002 - DNA, 19 bp, Artificial Sequence
  Description of Artificial Sequence: Chemically synthesized oligonucleotide
ggggccggggaagggggtc

SEQ ID NO: 2003 - DNA, 19 bp, Artificial Sequence
  Description of Artificial Sequence: Chemically synthesized oligonucleotide
acccccttccccggcccct

SEQ ID NO: 2004 - DNA, 19 bp, Artificial Sequence
  Description of Artificial Sequence: Chemically synthesized oligonucleotide
aggggccggggaagggggt

SEQ ID NO: 2005 - DNA, 19 bp, Artificial Sequence
  Description of Artificial Sequence: Chemically synthesized oligonucleotide
cccccttccccggcccctc

SEQ ID NO: 2006 - DNA, 19 bp, Artificial Sequence
  Description of Artificial Sequence: Chemically synthesized oligonucleotide
gaggggccggggaaggggg

SEQ ID NO: 2007 - DNA, 19 bp, Artificial Sequence
  Description of Artificial Sequence: Chemically synthesized oligonucleotide
ccccttccccggcccctcg

SEQ ID NO: 2008 - DNA, 19 bp, Artificial Sequence
  Description of Artificial Sequence: Chemically synthesized oligonucleotide
cgaggggccggggaagggg

SEQ ID NO: 2009 - DNA, 19 bp, Artificial Sequence
  Description of Artificial Sequence: Chemically synthesized oligonucleotide
cccttccccggcccctcgg

SEQ ID NO: 2010 - DNA, 19 bp, Artificial Sequence
  Description of Artificial Sequence: Chemically synthesized oligonucleotide
ccgaggggccggggaaggg

SEQ ID NO: 2011 - DNA, 19 bp, Artificial Sequence
  Description of Artificial Sequence: Chemically synthesized oligonucleotide
ccttccccggcccctcggc

SEQ ID NO: 2012 - DNA, 19 bp, Artificial Sequence
  Description of Artificial Sequence: Chemically synthesized oligonucleotide
gccgaggggccggggaagg

SEQ ID NO: 2013 - DNA, 19 bp, Artificial Sequence
  Description of Artificial Sequence: Chemically synthesized oligonucleotide
cttccccggcccctcggcc

SEQ ID NO: 2014 - DNA, 19 bp, Artificial Sequence
  Description of Artificial Sequence: Chemically synthesized oligonucleotide
ggccgaggggccggggaag

SEQ ID NO: 2015 - DNA, 19 bp, Artificial Sequence
  Description of Artificial Sequence: Chemically synthesized oligonucleotide
ttccccggcccctcggcct

SEQ ID NO: 2016 - DNA, 19 bp, Artificial Sequence
  Description of Artificial Sequence: Chemically synthesized oligonucleotide
aggccgaggggccggggaa

SEQ ID NO: 2017 - DNA, 19 bp, Artificial Sequence
  Description of Artificial Sequence: Chemically synthesized oligonucleotide
tccccggcccctcggcctt

SEQ ID NO: 2018 - DNA, 19 bp, Artificial Sequence
  Description of Artificial Sequence: Chemically synthesized oligonucleotide
aaggccgaggggccgggga

SEQ ID NO: 2019 - DNA, 19 bp, Artificial Sequence
  Description of Artificial Sequence: Chemically synthesized oligonucleotide
ccccggcccctcggccttt

SEQ ID NO: 2020 - DNA, 19 bp, Artificial Sequence
  Description of Artificial Sequence: Chemically synthesized oligonucleotide
aaaggccgaggggccgggg

SEQ ID NO: 2021 - DNA, 19 bp, Artificial Sequence
  Description of Artificial Sequence: Chemically synthesized oligonucleotide
cccggcccctcggcctttc

SEQ ID NO: 2022 - DNA, 19 bp, Artificial Sequence
  Description of Artificial Sequence: Chemically synthesized oligonucleotide
gaaaggccgaggggccggg

SEQ ID NO: 2023 - DNA, 19 bp, Artificial Sequence
  Description of Artificial Sequence: Chemically synthesized oligonucleotide
ccggcccctcggcctttcc

SEQ ID NO: 2024 - DNA, 19 bp, Artificial Sequence
  Description of Artificial Sequence: Chemically synthesized oligonucleotide
ggaaaggccgaggggccgg

SEQ ID NO: 2025 - DNA, 19 bp, Artificial Sequence
  Description of Artificial Sequence: Chemically synthesized oligonucleotide
cggcccctcggcctttccc

SEQ ID NO: 2026 - DNA, 19 bp, Artificial Sequence
  Description of Artificial Sequence: Chemically synthesized oligonucleotide
gggaaaggccgaggggccg

SEQ ID NO: 2027 - DNA, 19 bp, Artificial Sequence
  Description of Artificial Sequence: Chemically synthesized oligonucleotide
ggcccctcggcctttcccc

SEQ ID NO: 2028 - DNA, 19 bp, Artificial Sequence
  Description of Artificial Sequence: Chemically synthesized oligonucleotide
ggggaaaggccgaggggcc

SEQ ID NO: 2029 - DNA, 19 bp, Artificial Sequence
  Description of Artificial Sequence: Chemically synthesized oligonucleotide
gcccctcggcctttccccc

SEQ ID NO: 2030 - DNA, 19 bp, Artificial Sequence
  Description of Artificial Sequence: Chemically synthesized oligonucleotide
gggggaaaggccgaggggc

SEQ ID NO: 2031 - DNA, 19 bp, Artificial Sequence
  Description of Artificial Sequence: Chemically synthesized oligonucleotide
cccctcggcctttccccca

SEQ ID NO: 2032 - DNA, 19 bp, Artificial Sequence
  Description of Artificial Sequence: Chemically synthesized oligonucleotide
tgggggaaaggccgagggg

SEQ ID NO: 2033 - DNA, 19 bp, Artificial Sequence
  Description of Artificial Sequence: Chemically synthesized oligonucleotide
ccctcggcctttcccccaa

SEQ ID NO: 2034 - DNA, 19 bp, Artificial Sequence
  Description of Artificial Sequence: Chemically synthesized oligonucleotide
ttgggggaaaggccgaggg

SEQ ID NO: 2035 - DNA, 19 bp, Artificial Sequence
  Description of Artificial Sequence: Chemically synthesized oligonucleotide
cctcggcctttcccccaac

SEQ ID NO: 2036 - DNA, 19 bp, Artificial Sequence
  Description of Artificial Sequence: Chemically synthesized oligonucleotide
gttgggggaaaggccgagg

SEQ ID NO: 2037 - DNA, 19 bp, Artificial Sequence
  Description of Artificial Sequence: Chemically synthesized oligonucleotide
ctcggcctttcccccaact

SEQ ID NO: 2038 - DNA, 19 bp, Artificial Sequence
  Description of Artificial Sequence: Chemically synthesized oligonucleotide
agttgggggaaaggccgag

SEQ ID NO: 2039 - DNA, 19 bp, Artificial Sequence
  Description of Artificial Sequence: Chemically synthesized oligonucleotide
tcggcctttcccccaactc

SEQ ID NO: 2040 - DNA, 19 bp, Artificial Sequence
  Description of Artificial Sequence: Chemically synthesized oligonucleotide
gagttgggggaaaggccga

SEQ ID NO: 2041 - DNA, 19 bp, Artificial Sequence
  Description of Artificial Sequence: Chemically synthesized oligonucleotide
cggcctttcccccaactcg

SEQ ID NO: 2042 - DNA, 19 bp, Artificial Sequence
  Description of Artificial Sequence: Chemically synthesized oligonucleotide
cgagttgggggaaaggccg

SEQ ID NO: 2043 - DNA, 19 bp, Artificial Sequence
  Description of Artificial Sequence: Chemically synthesized oligonucleotide
ggcctttcccccaactcgg

SEQ ID NO: 2044 - DNA, 19 bp, Artificial Sequence
  Description of Artificial Sequence: Chemically synthesized oligonucleotide
ccgagttgggggaaaggcc

SEQ ID NO: 2045 - DNA, 19 bp, Artificial Sequence
  Description of Artificial Sequence: Chemically synthesized oligonucleotide
gcctttcccccaactcggc

SEQ ID NO: 2046 - DNA, 19 bp, Artificial Sequence
  Description of Artificial Sequence: Chemically synthesized oligonucleotide
gccgagttgggggaaaggc

SEQ ID NO: 2047 - DNA, 19 bp, Artificial Sequence
  Description of Artificial Sequence: Chemically synthesized oligonucleotide
cctttcccccaactcggcc

SEQ ID NO: 2048 - DNA, 19 bp, Artificial Sequence
  Description of Artificial Sequence: Chemically synthesized oligonucleotide
ggccgagttgggggaaagg

SEQ ID NO: 2049 - DNA, 19 bp, Artificial Sequence
  Description of Artificial Sequence: Chemically synthesized oligonucleotide
ctttcccccaactcggcca

SEQ ID NO: 2050 - DNA, 19 bp, Artificial Sequence
  Description of Artificial Sequence: Chemically synthesized oligonucleotide
tggccgagttgggggaaag

SEQ ID NO: 2051 - DNA, 19 bp, Artificial Sequence
  Description of Artificial Sequence: Chemically synthesized oligonucleotide
tttcccccaactcggccat

SEQ ID NO: 2052 - DNA, 19 bp, Artificial Sequence
  Description of Artificial Sequence: Chemically synthesized oligonucleotide
atggccgagttgggggaaa

SEQ ID NO: 2053 - DNA, 19 bp, Artificial Sequence
  Description of Artificial Sequence: Chemically synthesized oligonucleotide
ttcccccaactcggccatc

SEQ ID NO: 2054 - DNA, 19 bp, Artificial Sequence
  Description of Artificial Sequence: Chemically synthesized oligonucleotide
gatggccgagttgggggaa

SEQ ID NO: 2055 - DNA, 19 bp, Artificial Sequence
  Description of Artificial Sequence: Chemically synthesized oligonucleotide
tcccccaactcggccatct

SEQ ID NO: 2056 - DNA, 19 bp, Artificial Sequence
  Description of Artificial Sequence: Chemically synthesized oligonucleotide
agatggccgagttggggga

SEQ ID NO: 2057 - DNA, 19 bp, Artificial Sequence
  Description of Artificial Sequence: Chemically synthesized oligonucleotide
cccccaactcggccatctc

SEQ ID NO: 2058 - DNA, 19 bp, Artificial Sequence
  Description of Artificial Sequence: Chemically synthesized oligonucleotide
gagatggccgagttggggg

SEQ ID NO: 2059 - DNA, 19 bp, Artificial Sequence
  Description of Artificial Sequence: Chemically synthesized oligonucleotide
ccccaactcggccatctcc

SEQ ID NO: 2060 - DNA, 19 bp, Artificial Sequence
  Description of Artificial Sequence: Chemically synthesized oligonucleotide
ggagatggccgagttgggg

SEQ ID NO: 2061 - DNA, 19 bp, Artificial Sequence
  Description of Artificial Sequence: Chemically synthesized oligonucleotide
cccaactcggccatctccg

SEQ ID NO: 2062 - DNA, 19 bp, Artificial Sequence
  Description of Artificial Sequence: Chemically synthesized oligonucleotide
cggagatggccgagttggg

SEQ ID NO: 2063 - DNA, 19 bp, Artificial Sequence
  Description of Artificial Sequence: Chemically synthesized oligonucleotide
ccaactcggccatctccga

SEQ ID NO: 2064 - DNA, 19 bp, Artificial Sequence
  Description of Artificial Sequence: Chemically synthesized oligonucleotide
tcggagatggccgagttgg

SEQ ID NO: 2065 - DNA, 19 bp, Artificial Sequence
  Description of Artificial Sequence: Chemically synthesized oligonucleotide
caactcggccatctccgac

SEQ ID NO: 2066 - DNA, 19 bp, Artificial Sequence
  Description of Artificial Sequence: Chemically synthesized oligonucleotide
gtcggagatggccgagttg

SEQ ID NO: 2067 - DNA, 19 bp, Artificial Sequence
  Description of Artificial Sequence: Chemically synthesized oligonucleotide
aactcggccatctccgacc

SEQ ID NO: 2068 - DNA, 19 bp, Artificial Sequence
  Description of Artificial Sequence: Chemically synthesized oligonucleotide
ggtcggagatggccgagtt

SEQ ID NO: 2069 - DNA, 19 bp, Artificial Sequence
  Description of Artificial Sequence: Chemically synthesized oligonucleotide
actcggccatctccgaccc

SEQ ID NO: 2070 - DNA, 19 bp, Artificial Sequence
  Description of Artificial Sequence: Chemically synthesized oligonucleotide
gggtcggagatggccgagt

SEQ ID NO: 2071 - DNA, 19 bp, Artificial Sequence
  Description of Artificial Sequence: Chemically synthesized oligonucleotide
ctcggccatctccgacccg

SEQ ID NO: 2072 - DNA, 19 bp, Artificial Sequence
  Description of Artificial Sequence: Chemically synthesized oligonucleotide
cgggtcggagatggccgag

SEQ ID NO: 2073 - DNA, 19 bp, Artificial Sequence
  Description of Artificial Sequence: Chemically synthesized oligonucleotide
tcggccatctccgacccgg

SEQ ID NO: 2074 - DNA, 19 bp, Artificial Sequence
  Description of Artificial Sequence: Chemically synthesized oligonucleotide
ccgggtcggagatggccga

SEQ ID NO: 2075 - DNA, 19 bp, Artificial Sequence
  Description of Artificial Sequence: Chemically synthesized oligonucleotide
cggccatctccgacccggg

SEQ ID NO: 2076 - DNA, 19 bp, Artificial Sequence
  Description of Artificial Sequence: Chemically synthesized oligonucleotide
cccgggtcggagatggccg

SEQ ID NO: 2077 - DNA, 19 bp, Artificial Sequence
  Description of Artificial Sequence: Chemically synthesized oligonucleotide
ggccatctccgacccgggg

SEQ ID NO: 2078 - DNA, 19 bp, Artificial Sequence
  Description of Artificial Sequence: Chemically synthesized oligonucleotide
ccccgggtcggagatggcc

SEQ ID NO: 2079 - DNA, 19 bp, Artificial Sequence
  Description of Artificial Sequence: Chemically synthesized oligonucleotide
gccatctccgacccggggc

SEQ ID NO: 2080 - DNA, 19 bp, Artificial Sequence
  Description of Artificial Sequence: Chemically synthesized oligonucleotide
gccccgggtcggagatggc

SEQ ID NO: 2081 - DNA, 19 bp, Artificial Sequence
  Description of Artificial Sequence: Chemically synthesized oligonucleotide
ccatctccgacccggggcg

SEQ ID NO: 2082 - DNA, 19 bp, Artificial Sequence
  Description of Artificial Sequence: Chemically synthesized oligonucleotide
cgccccgggtcggagatgg

SEQ ID NO: 2083 - DNA, 19 bp, Artificial Sequence
  Description of Artificial Sequence: Chemically synthesized oligonucleotide
catctccgacccggggcgc

SEQ ID NO: 2084 - DNA, 19 bp, Artificial Sequence
  Description of Artificial Sequence: Chemically synthesized oligonucleotide
gcgccccgggtcggagatg

SEQ ID NO: 2085 - DNA, 19 bp, Artificial Sequence
  Description of Artificial Sequence: Chemically synthesized oligonucleotide
atctccgacccggggcgcg

SEQ ID NO: 2086 - DNA, 19 bp, Artificial Sequence
  Description of Artificial Sequence: Chemically synthesized oligonucleotide
cgcgccccgggtcggagat

SEQ ID NO: 2087 - DNA, 19 bp, Artificial Sequence
  Description of Artificial Sequence: Chemically synthesized oligonucleotide
tctccgacccggggcgcgt

SEQ ID NO: 2088 - DNA, 19 bp, Artificial Sequence
  Description of Artificial Sequence: Chemically synthesized oligonucleotide
acgcgccccgggtcggaga

SEQ ID NO: 2089 - DNA, 19 bp, Artificial Sequence
  Description of Artificial Sequence: Chemically synthesized oligonucleotide
ctccgacccggggcgcgtg

SEQ ID NO: 2090 - DNA, 19 bp, Artificial Sequence
  Description of Artificial Sequence: Chemically synthesized oligonucleotide
cacgcgccccgggtcggag

SEQ ID NO: 2091 - DNA, 19 bp, Artificial Sequence
  Description of Artificial Sequence: Chemically synthesized oligonucleotide
tccgacccggggcgcgtgt

SEQ ID NO: 2092 - DNA, 19 bp, Artificial Sequence
  Description of Artificial Sequence: Chemically synthesized oligonucleotide
acacgcgccccgggtcgga

SEQ ID NO: 2093 - DNA, 19 bp, Artificial Sequence
  Description of Artificial Sequence: Chemically synthesized oligonucleotide
ccgacccggggcgcgtgtt

SEQ ID NO: 2094 - DNA, 19 bp, Artificial Sequence
  Description of Artificial Sequence: Chemically synthesized oligonucleotide
aacacgcgccccgggtcgg

SEQ ID NO: 2095 - DNA, 19 bp, Artificial Sequence
  Description of Artificial Sequence: Chemically synthesized oligonucleotide
cgacccggggcgcgtgttc

SEQ ID NO: 2096 - DNA, 19 bp, Artificial Sequence
  Description of Artificial Sequence: Chemically synthesized oligonucleotide
gaacacgcgccccgggtcg

SEQ ID NO: 2097 - DNA, 19 bp, Artificial Sequence
  Description of Artificial Sequence: Chemically synthesized oligonucleotide
gacccggggcgcgtgttcc

SEQ ID NO: 2098 - DNA, 19 bp, Artificial Sequence
  Description of Artificial Sequence: Chemically synthesized oligonucleotide
ggaacacgcgccccgggtc

SEQ ID NO: 2099 - DNA, 19 bp, Artificial Sequence
  Description of Artificial Sequence: Chemically synthesized oligonucleotide
acccggggcgcgtgttccc

SEQ ID NO: 2100 - DNA, 19 bp, Artificial Sequence
  Description of Artificial Sequence: Chemically synthesized oligonucleotide
gggaacacgcgccccgggt

SEQ ID NO: 2101 - DNA, 19 bp, Artificial Sequence
  Description of Artificial Sequence: Chemically synthesized oligonucleotide
cccggggcgcgtgttcccc

SEQ ID NO: 2102 - DNA, 19 bp, Artificial Sequence
  Description of Artificial Sequence: Chemically synthesized oligonucleotide
ggggaacacgcgccccggg

SEQ ID NO: 2103 - DNA, 19 bp, Artificial Sequence
  Description of Artificial Sequence: Chemically synthesized oligonucleotide
ccggggcgcgtgttccccc

SEQ ID NO: 2104 - DNA, 19 bp, Artificial Sequence
  Description of Artificial Sequence: Chemically synthesized oligonucleotide
gggggaacacgcgccccgg

SEQ ID NO: 2105 - DNA, 19 bp, Artificial Sequence
  Description of Artificial Sequence: Chemically synthesized oligonucleotide
cggggcgcgtgttcccccc

SEQ ID NO: 2106 - DNA, 19 bp, Artificial Sequence
  Description of Artificial Sequence: Chemically synthesized oligonucleotide
ggggggaacacgcgccccg

SEQ ID NO: 2107 - DNA, 19 bp, Artificial Sequence
  Description of Artificial Sequence: Chemically synthesized oligonucleotide
ggggcgcgtgttccccccg

SEQ ID NO: 2108 - DNA, 19 bp, Artificial Sequence
  Description of Artificial Sequence: Chemically synthesized oligonucleotide
cggggggaacacgcgcccc

SEQ ID NO: 2109 - DNA, 19 bp, Artificial Sequence
  Description of Artificial Sequence: Chemically synthesized oligonucleotide
gggcgcgtgttccccccgg

SEQ ID NO: 2110 - DNA, 19 bp, Artificial Sequence
  Description of Artificial Sequence: Chemically synthesized oligonucleotide
ccggggggaacacgcgccc

SEQ ID NO: 2111 - DNA, 19 bp, Artificial Sequence
  Description of Artificial Sequence: Chemically synthesized oligonucleotide
ggcgcgtgttccccccggc

SEQ ID NO: 2112 - DNA, 19 bp, Artificial Sequence
  Description of Artificial Sequence: Chemically synthesized oligonucleotide
gccggggggaacacgcgcc

SEQ ID NO: 2113 - DNA, 19 bp, Artificial Sequence
  Description of Artificial Sequence: Chemically synthesized oligonucleotide
gcgcgtgttccccccggcc

SEQ ID NO: 2114 - DNA, 19 bp, Artificial Sequence
  Description of Artificial Sequence: Chemically synthesized oligonucleotide
ggccggggggaacacgcgc

SEQ ID NO: 2115 - DNA, 19 bp, Artificial Sequence
  Description of Artificial Sequence: Chemically synthesized oligonucleotide
cgcgtgttccccccggccc

SEQ ID NO: 2116 - DNA, 19 bp, Artificial Sequence
  Description of Artificial Sequence: Chemically synthesized oligonucleotide
gggccggggggaacacgcg

SEQ ID NO: 2117 - DNA, 19 bp, Artificial Sequence
  Description of Artificial Sequence: Chemically synthesized oligonucleotide
gcgtgttccccccggcccg

SEQ ID NO: 2118 - DNA, 19 bp, Artificial Sequence
  Description of Artificial Sequence: Chemically synthesized oligonucleotide
cgggccggggggaacacgc

SEQ ID NO: 2119 - DNA, 19 bp, Artificial Sequence
  Description of Artificial Sequence: Chemically synthesized oligonucleotide
cgtgttccccccggcccgg

SEQ ID NO: 2120 - DNA, 19 bp, Artificial Sequence
  Description of Artificial Sequence: Chemically synthesized oligonucleotide
ccgggccggggggaacacg

SEQ ID NO: 2121 - DNA, 19 bp, Artificial Sequence
  Description of Artificial Sequence: Chemically synthesized oligonucleotide
gtgttccccccggcccggc

SEQ ID NO: 2122 - DNA, 19 bp, Artificial Sequence
  Description of Artificial Sequence: Chemically synthesized oligonucleotide
gccgggccggggggaacac

SEQ ID NO: 2123 - DNA, 19 bp, Artificial Sequence
  Description of Artificial Sequence: Chemically synthesized oligonucleotide
tgttccccccggcccggcg

SEQ ID NO: 2124 - DNA, 19 bp, Artificial Sequence
  Description of Artificial Sequence: Chemically synthesized oligonucleotide
cgccgggccggggggaaca

SEQ ID NO: 2125 - DNA, 19 bp, Artificial Sequence
  Description of Artificial Sequence: Chemically synthesized oligonucleotide
gttccccccggcccggcgc

SEQ ID NO: 2126 - DNA, 19 bp, Artificial Sequence
  Description of Artificial Sequence: Chemically synthesized oligonucleotide
gcgccgggccggggggaac

SEQ ID NO: 2127 - DNA, 19 bp, Artificial Sequence
  Description of Artificial Sequence: Chemically synthesized oligonucleotide
ttccccccggcccggcgcc

SEQ ID NO: 2128 - DNA, 19 bp, Artificial Sequence
  Description of Artificial Sequence: Chemically synthesized oligonucleotide
ggcgccgggccggggggaa

SEQ ID NO: 2129 - DNA, 19 bp, Artificial Sequence
  Description of Artificial Sequence: Chemically synthesized oligonucleotide
tccccccggcccggcgcct

SEQ ID NO: 2130 - DNA, 19 bp, Artificial Sequence
  Description of Artificial Sequence: Chemically synthesized oligonucleotide
aggcgccgggccgggggga

SEQ ID NO: 2131 - DNA, 19 bp, Artificial Sequence
  Description of Artificial Sequence: Chemically synthesized oligonucleotide
ccccccggcccggcgcctt

SEQ ID NO: 2132 - DNA, 19 bp, Artificial Sequence
  Description of Artificial Sequence: Chemically synthesized oligonucleotide
aaggcgccgggccgggggg

SEQ ID NO: 2133 - DNA, 19 bp, Artificial Sequence
  Description of Artificial Sequence: Chemically synthesized oligonucleotide
cccccggcccggcgccttc

SEQ ID NO: 2134 - DNA, 19 bp, Artificial Sequence
  Description of Artificial Sequence: Chemically synthesized oligonucleotide
gaaggcgccgggccggggg

SEQ ID NO: 2135 - DNA, 19 bp, Artificial Sequence
  Description of Artificial Sequence: Chemically synthesized oligonucleotide
ccccggcccggcgccttct

SEQ ID NO: 2136 - DNA, 19 bp, Artificial Sequence
  Description of Artificial Sequence: Chemically synthesized oligonucleotide
agaaggcgccgggccgggg

SEQ ID NO: 2137 - DNA, 19 bp, Artificial Sequence
  Description of Artificial Sequence: Chemically synthesized oligonucleotide
cccggcccggcgccttctc

SEQ ID NO: 2138 - DNA, 19 bp, Artificial Sequence
  Description of Artificial Sequence: Chemically synthesized oligonucleotide
gagaaggcgccgggccggg

SEQ ID NO: 2139 - DNA, 19 bp, Artificial Sequence
  Description of Artificial Sequence: Chemically synthesized oligonucleotide
ccggcccggcgccttctct

SEQ ID NO: 2140 - DNA, 19 bp, Artificial Sequence
  Description of Artificial Sequence: Chemically synthesized oligonucleotide
agagaaggcgccgggccgg

SEQ ID NO: 2141 - DNA, 19 bp, Artificial Sequence
  Description of Artificial Sequence: Chemically synthesized oligonucleotide
cggcccggcgccttctctc

SEQ ID NO: 2142 - DNA, 19 bp, Artificial Sequence
  Description of Artificial Sequence: Chemically synthesized oligonucleotide
gagagaaggcgccgggccg

SEQ ID NO: 2143 - DNA, 19 bp, Artificial Sequence
  Description of Artificial Sequence: Chemically synthesized oligonucleotide
ggcccggcgccttctctcc

SEQ ID NO: 2144 - DNA, 19 bp, Artificial Sequence
  Description of Artificial Sequence: Chemically synthesized oligonucleotide
ggagagaaggcgccgggcc

SEQ ID NO: 2145 - DNA, 19 bp, Artificial Sequence
  Description of Artificial Sequence: Chemically synthesized oligonucleotide
gcccggcgccttctctccc

SEQ ID NO: 2146 - DNA, 19 bp, Artificial Sequence
  Description of Artificial Sequence: Chemically synthesized oligonucleotide
gggagagaaggcgccgggc

SEQ ID NO: 2147 - DNA, 19 bp, Artificial Sequence
  Description of Artificial Sequence: Chemically synthesized oligonucleotide
cccggcgccttctctccct

SEQ ID NO: 2148 - DNA, 19 bp, Artificial Sequence
  Description of Artificial Sequence: Chemically synthesized oligonucleotide
agggagagaaggcgccggg

SEQ ID NO: 2149 - DNA, 19 bp, Artificial Sequence
  Description of Artificial Sequence: Chemically synthesized oligonucleotide
ccggcgccttctctccctc

SEQ ID NO: 2150 - DNA, 19 bp, Artificial Sequence
  Description of Artificial Sequence: Chemically synthesized oligonucleotide
gagggagagaaggcgccgg

SEQ ID NO: 2151 - DNA, 19 bp, Artificial Sequence
  Description of Artificial Sequence: Chemically synthesized oligonucleotide
cggcgccttctctccctcc

SEQ ID NO: 2152 - DNA, 19 bp, Artificial Sequence
  Description of Artificial Sequence: Chemically synthesized oligonucleotide
ggagggagagaaggcgccg

SEQ ID NO: 2153 - DNA, 19 bp, Artificial Sequence
  Description of Artificial Sequence: Chemically synthesized oligonucleotide
ggcgccttctctccctccg

SEQ ID NO: 2154 - DNA, 19 bp, Artificial Sequence
  Description of Artificial Sequence: Chemically synthesized oligonucleotide
cggagggagagaaggcgcc

SEQ ID NO: 2155 - DNA, 19 bp, Artificial Sequence
  Description of Artificial Sequence: Chemically synthesized oligonucleotide
gcgccttctctccctccgg

SEQ ID NO: 2156 - DNA, 19 bp, Artificial Sequence
  Description of Artificial Sequence: Chemically synthesized oligonucleotide
ccggagggagagaaggcgc

SEQ ID NO: 2157 - DNA, 19 bp, Artificial Sequence
  Description of Artificial Sequence: Chemically synthesized oligonucleotide
cgccttctctccctccggg

SEQ ID NO: 2158 - DNA, 19 bp, Artificial Sequence
  Description of Artificial Sequence: Chemically synthesized oligonucleotide
cccggagggagagaaggcg

SEQ ID NO: 2159 - DNA, 19 bp, Artificial Sequence
  Description of Artificial Sequence: Chemically synthesized oligonucleotide
gccttctctccctccgggg

SEQ ID NO: 2160 - DNA, 19 bp, Artificial Sequence
  Description of Artificial Sequence: Chemically synthesized oligonucleotide
ccccggagggagagaaggc

SEQ ID NO: 2161 - DNA, 19 bp, Artificial Sequence
  Description of Artificial Sequence: Chemically synthesized oligonucleotide
ccttctctccctccggggg

SEQ ID NO: 2162 - DNA, 19 bp, Artificial Sequence
  Description of Artificial Sequence: Chemically synthesized oligonucleotide
cccccggagggagagaagg

SEQ ID NO: 2163 - DNA, 19 bp, Artificial Sequence
  Description of Artificial Sequence: Chemically synthesized oligonucleotide
cttctctccctccgggggc

SEQ ID NO: 2164 - DNA, 19 bp, Artificial Sequence
  Description of Artificial Sequence: Chemically synthesized oligonucleotide
gcccccggagggagagaag

SEQ ID NO: 2165 - DNA, 19 bp, Artificial Sequence
  Description of Artificial Sequence: Chemically synthesized oligonucleotide
ttctctccctccgggggca

SEQ ID NO: 2166 - DNA, 19 bp, Artificial Sequence
  Description of Artificial Sequence: Chemically synthesized oligonucleotide
tgcccccggagggagagaa

SEQ ID NO: 2167 - DNA, 19 bp, Artificial Sequence
  Description of Artificial Sequence: Chemically synthesized oligonucleotide
tctctccctccgggggcac

SEQ ID NO: 2168 - DNA, 19 bp, Artificial Sequence
  Description of Artificial Sequence: Chemically synthesized oligonucleotide
gtgcccccggagggagaga

SEQ ID NO: 2169 - DNA, 19 bp, Artificial Sequence
  Description of Artificial Sequence: Chemically synthesized oligonucleotide
ctctccctccgggggcacc

SEQ ID NO: 2170 - DNA, 19 bp, Artificial Sequence
  Description of Artificial Sequence: Chemically synthesized oligonucleotide
ggtgcccccggagggagag

SEQ ID NO: 2171 - DNA, 19 bp, Artificial Sequence
  Description of Artificial Sequence: Chemically synthesized oligonucleotide
tctccctccgggggcaccc

SEQ ID NO: 2172 - DNA, 19 bp, Artificial Sequence
  Description of Artificial Sequence: Chemically synthesized oligonucleotide
gggtgcccccggagggaga

SEQ ID NO: 2173 - DNA, 19 bp, Artificial Sequence
  Description of Artificial Sequence: Chemically synthesized oligonucleotide
ctccctccgggggcacccg

SEQ ID NO: 2174 - DNA, 19 bp, Artificial Sequence
  Description of Artificial Sequence: Chemically synthesized oligonucleotide
cgggtgcccccggagggag

SEQ ID NO: 2175 - DNA, 19 bp, Artificial Sequence
  Description of Artificial Sequence: Chemically synthesized oligonucleotide
tccctccgggggcacccgc

SEQ ID NO: 2176 - DNA, 19 bp, Artificial Sequence
  Description of Artificial Sequence: Chemically synthesized oligonucleotide
gcgggtgcccccggaggga

SEQ ID NO: 2177 - DNA, 19 bp, Artificial Sequence
  Description of Artificial Sequence: Chemically synthesized oligonucleotide
ccctccgggggcacccgct

SEQ ID NO: 2178 - DNA, 19 bp, Artificial Sequence
  Description of Artificial Sequence: Chemically synthesized oligonucleotide
agcgggtgcccccggaggg

SEQ ID NO: 2179 - DNA, 19 bp, Artificial Sequence
  Description of Artificial Sequence: Chemically synthesized oligonucleotide
cctccgggggcacccgctc

SEQ ID NO: 2180 - DNA, 19 bp, Artificial Sequence
  Description of Artificial Sequence: Chemically synthesized oligonucleotide
gagcgggtgcccccggagg

SEQ ID NO: 2181 - DNA, 19 bp, Artificial Sequence
  Description of Artificial Sequence: Chemically synthesized oligonucleotide
ctccgggggcacccgctcc

SEQ ID NO: 2182 - DNA, 19 bp, Artificial Sequence
  Description of Artificial Sequence: Chemically synthesized oligonucleotide
ggagcgggtgcccccggag

SEQ ID NO: 2183 - DNA, 19 bp, Artificial Sequence
  Description of Artificial Sequence: Chemically synthesized oligonucleotide
tccgggggcacccgctccc

SEQ ID NO: 2184 - DNA, 19 bp, Artificial Sequence
  Description of Artificial Sequence: Chemically synthesized oligonucleotide
gggagcgggtgcccccgga

SEQ ID NO: 2185 - DNA, 19 bp, Artificial Sequence
  Description of Artificial Sequence: Chemically synthesized oligonucleotide
ccgggggcacccgctccct

SEQ ID NO: 2186 - DNA, 19 bp, Artificial Sequence
  Description of Artificial Sequence: Chemically synthesized oligonucleotide
agggagcgggtgcccccgg

SEQ ID NO: 2187 - DNA, 19 bp, Artificial Sequence
  Description of Artificial Sequence: Chemically synthesized oligonucleotide
cgggggcacccgctcccta

SEQ ID NO: 2188 - DNA, 19 bp, Artificial Sequence
  Description of Artificial Sequence: Chemically synthesized oligonucleotide
tagggagcgggtgcccccg

SEQ ID NO: 2189 - DNA, 19 bp, Artificial Sequence
  Description of Artificial Sequence: Chemically synthesized oligonucleotide
gggggcacccgctccctag

SEQ ID NO: 2190 - DNA, 19 bp, Artificial Sequence
  Description of Artificial Sequence: Chemically synthesized oligonucleotide
ctagggagcgggtgccccc

SEQ ID NO: 2191 - DNA, 19 bp, Artificial Sequence
  Description of Artificial Sequence: Chemically synthesized oligonucleotide
ggggcacccgctccctagc

SEQ ID NO: 2192 - DNA, 19 bp, Artificial Sequence
  Description of Artificial Sequence: Chemically synthesized oligonucleotide
gctagggagcgggtgcccc

SEQ ID NO: 2193 - DNA, 19 bp, Artificial Sequence
  Description of Artificial Sequence: Chemically synthesized oligonucleotide
gggcacccgctccctagcc

SEQ ID NO: 2194 - DNA, 19 bp, Artificial Sequence
  Description of Artificial Sequence: Chemically synthesized oligonucleotide
ggctagggagcgggtgccc

SEQ ID NO: 2195 - DNA, 19 bp, Artificial Sequence
  Description of Artificial Sequence: Chemically synthesized oligonucleotide
ggcacccgctccctagccc

SEQ ID NO: 2196 - DNA, 19 bp, Artificial Sequence
  Description of Artificial Sequence: Chemically synthesized oligonucleotide
gggctagggagcgggtgcc

SEQ ID NO: 2197 - DNA, 19 bp, Artificial Sequence
  Description of Artificial Sequence: Chemically synthesized oligonucleotide
gcacccgctccctagcccc

SEQ ID NO: 2198 - DNA, 19 bp, Artificial Sequence
  Description of Artificial Sequence: Chemically synthesized oligonucleotide
ggggctagggagcgggtgc

SEQ ID NO: 2199 - DNA, 19 bp, Artificial Sequence
  Description of Artificial Sequence: Chemically synthesized oligonucleotide
cacccgctccctagccccg

SEQ ID NO: 2200 - DNA, 19 bp, Artificial Sequence
  Description of Artificial Sequence: Chemically synthesized oligonucleotide
cggggctagggagcgggtg

SEQ ID NO: 2201 - DNA, 19 bp, Artificial Sequence
  Description of Artificial Sequence: Chemically synthesized oligonucleotide
acccgctccctagccccgg

SEQ ID NO: 2202 - DNA, 19 bp, Artificial Sequence
  Description of Artificial Sequence: Chemically synthesized oligonucleotide
ccggggctagggagcgggt

SEQ ID NO: 2203 - DNA, 19 bp, Artificial Sequence
  Description of Artificial Sequence: Chemically synthesized oligonucleotide
cccgctccctagccccggc

SEQ ID NO: 2204 - DNA, 19 bp, Artificial Sequence
  Description of Artificial Sequence: Chemically synthesized oligonucleotide
gccggggctagggagcggg

SEQ ID NO: 2205 - DNA, 19 bp, Artificial Sequence
  Description of Artificial Sequence: Chemically synthesized oligonucleotide
ccgctccctagccccggcc

SEQ ID NO: 2206 - DNA, 19 bp, Artificial Sequence
  Description of Artificial Sequence: Chemically synthesized oligonucleotide
ggccggggctagggagcgg

SEQ ID NO: 2207 - DNA, 19 bp, Artificial Sequence
  Description of Artificial Sequence: Chemically synthesized oligonucleotide
cgctccctagccccggccc

SEQ ID NO: 2208 - DNA, 19 bp, Artificial Sequence
  Description of Artificial Sequence: Chemically synthesized oligonucleotide
gggccggggctagggagcg

SEQ ID NO: 2209 - DNA, 19 bp, Artificial Sequence
  Description of Artificial Sequence: Chemically synthesized oligonucleotide
gctccctagccccggcccg

SEQ ID NO: 2210 - DNA, 19 bp, Artificial Sequence
  Description of Artificial Sequence: Chemically synthesized oligonucleotide
cgggccggggctagggagc

SEQ ID NO: 2211 - DNA, 19 bp, Artificial Sequence
  Description of Artificial Sequence: Chemically synthesized oligonucleotide
ctccctagccccggcccgg

SEQ ID NO: 2212 - DNA, 19 bp, Artificial Sequence
  Description of Artificial Sequence: Chemically synthesized oligonucleotide
ccgggccggggctagggag

SEQ ID NO: 2213 - DNA, 19 bp, Artificial Sequence
  Description of Artificial Sequence: Chemically synthesized oligonucleotide
tccctagccccggcccggc

SEQ ID NO: 2214 - DNA, 19 bp, Artificial Sequence
  Description of Artificial Sequence: Chemically synthesized oligonucleotide
gccgggccggggctaggga

SEQ ID NO: 2215 - DNA, 19 bp, Artificial Sequence
  Description of Artificial Sequence: Chemically synthesized oligonucleotide
ccctagccccggcccggcc

SEQ ID NO: 2216 - DNA, 19 bp, Artificial Sequence
  Description of Artificial Sequence: Chemically synthesized oligonucleotide
ggccgggccggggctaggg

SEQ ID NO: 2217 - DNA, 19 bp, Artificial Sequence
  Description of Artificial Sequence: Chemically synthesized oligonucleotide
cctagccccggcccggccc

SEQ ID NO: 2218 - DNA, 19 bp, Artificial Sequence
  Description of Artificial Sequence: Chemically synthesized oligonucleotide
gggccgggccggggctagg

SEQ ID NO: 2219 - DNA, 19 bp, Artificial Sequence
  Description of Artificial Sequence: Chemically synthesized oligonucleotide
ctagccccggcccggccct

SEQ ID NO: 2220 - DNA, 19 bp, Artificial Sequence
  Description of Artificial Sequence: Chemically synthesized oligonucleotide
agggccgggccggggctag

SEQ ID NO: 2221 - DNA, 19 bp, Artificial Sequence
  Description of Artificial Sequence: Chemically synthesized oligonucleotide
tagccccggcccggccctc

SEQ ID NO: 2222 - DNA, 19 bp, Artificial Sequence
  Description of Artificial Sequence: Chemically synthesized oligonucleotide
gagggccgggccggggcta

SEQ ID NO: 2223 - DNA, 19 bp, Artificial Sequence
  Description of Artificial Sequence: Chemically synthesized oligonucleotide
agccccggcccggccctcc

SEQ ID NO: 2224 - DNA, 19 bp, Artificial Sequence
  Description of Artificial Sequence: Chemically synthesized oligonucleotide
ggagggccgggccggggct

SEQ ID NO: 2225 - DNA, 19 bp, Artificial Sequence
  Description of Artificial Sequence: Chemically synthesized oligonucleotide
gccccggcccggccctccc

SEQ ID NO: 2226 - DNA, 19 bp, Artificial Sequence
  Description of Artificial Sequence: Chemically synthesized oligonucleotide
gggagggccgggccggggc

SEQ ID NO: 2227 - DNA, 19 bp, Artificial Sequence
  Description of Artificial Sequence: Chemically synthesized oligonucleotide
ccccggcccggccctcccc

SEQ ID NO: 2228 - DNA, 19 bp, Artificial Sequence
  Description of Artificial Sequence: Chemically synthesized oligonucleotide
ggggagggccgggccgggg

SEQ ID NO: 2229 - DNA, 19 bp, Artificial Sequence
  Description of Artificial Sequence: Chemically synthesized oligonucleotide
cccggcccggccctccccg

SEQ ID NO: 2230 - DNA, 19 bp, Artificial Sequence
  Description of Artificial Sequence: Chemically synthesized oligonucleotide
cggggagggccgggccggg

SEQ ID NO: 2231 - DNA, 19 bp, Artificial Sequence
  Description of Artificial Sequence: Chemically synthesized oligonucleotide
ccggcccggccctccccgc

SEQ ID NO: 2232 - DNA, 19 bp, Artificial Sequence
  Description of Artificial Sequence: Chemically synthesized oligonucleotide
gcggggagggccgggccgg

SEQ ID NO: 2233 - DNA, 19 bp, Artificial Sequence
  Description of Artificial Sequence: Chemically synthesized oligonucleotide
cggcccggccctccccgcg

SEQ ID NO: 2234 - DNA, 19 bp, Artificial Sequence
  Description of Artificial Sequence: Chemically synthesized oligonucleotide
cgcggggagggccgggccg

SEQ ID NO: 2235 - DNA, 19 bp, Artificial Sequence
  Description of Artificial Sequence: Chemically synthesized oligonucleotide
ggcccggccctccccgcgg

SEQ ID NO: 2236 - DNA, 19 bp, Artificial Sequence
  Description of Artificial Sequence: Chemically synthesized oligonucleotide
ccgcggggagggccgggcc

SEQ ID NO: 2237 - DNA, 19 bp, Artificial Sequence
  Description of Artificial Sequence: Chemically synthesized oligonucleotide
gcccggccctccccgcggc

SEQ ID NO: 2238 - DNA, 19 bp, Artificial Sequence
  Description of Artificial Sequence: Chemically synthesized oligonucleotide
gccgcggggagggccgggc

SEQ ID NO: 2239 - DNA, 19 bp, Artificial Sequence
  Description of Artificial Sequence: Chemically synthesized oligonucleotide
cccggccctccccgcggcg

SEQ ID NO: 2240 - DNA, 19 bp, Artificial Sequence
  Description of Artificial Sequence: Chemically synthesized oligonucleotide
cgccgcggggagggccggg

SEQ ID NO: 2241 - DNA, 19 bp, Artificial Sequence
  Description of Artificial Sequence: Chemically synthesized oligonucleotide
ccggccctccccgcggcgc

SEQ ID NO: 2242 - DNA, 19 bp, Artificial Sequence
  Description of Artificial Sequence: Chemically synthesized oligonucleotide
gcgccgcggggagggccgg

SEQ ID NO: 2243 - DNA, 19 bp, Artificial Sequence
  Description of Artificial Sequence: Chemically synthesized oligonucleotide
cggccctccccgcggcgca

SEQ ID NO: 2244 - DNA, 19 bp, Artificial Sequence
  Description of Artificial Sequence: Chemically synthesized oligonucleotide
tgcgccgcggggagggccg

SEQ ID NO: 2245 - DNA, 19 bp, Artificial Sequence
  Description of Artificial Sequence: Chemically synthesized oligonucleotide
ggccctccccgcggcgcag

SEQ ID NO: 2246 - DNA, 19 bp, Artificial Sequence
  Description of Artificial Sequence: Chemically synthesized oligonucleotide
ctgcgccgcggggagggcc

SEQ ID NO: 2247 - DNA, 19 bp, Artificial Sequence
  Description of Artificial Sequence: Chemically synthesized oligonucleotide
gccctccccgcggcgcagc

SEQ ID NO: 2248 - DNA, 19 bp, Artificial Sequence
  Description of Artificial Sequence: Chemically synthesized oligonucleotide
gctgcgccgcggggagggc

SEQ ID NO: 2249 - DNA, 19 bp, Artificial Sequence
  Description of Artificial Sequence: Chemically synthesized oligonucleotide
ccctccccgcggcgcagca

SEQ ID NO: 2250 - DNA, 19 bp, Artificial Sequence
  Description of Artificial Sequence: Chemically synthesized oligonucleotide
tgctgcgccgcggggaggg

SEQ ID NO: 2251 - DNA, 19 bp, Artificial Sequence
  Description of Artificial Sequence: Chemically synthesized oligonucleotide
cctccccgcggcgcagcac

SEQ ID NO: 2252 - DNA, 19 bp, Artificial Sequence
  Description of Artificial Sequence: Chemically synthesized oligonucleotide
gtgctgcgccgcggggagg

SEQ ID NO: 2253 - DNA, 19 bp, Artificial Sequence
  Description of Artificial Sequence: Chemically synthesized oligonucleotide
ctccccgcggcgcagcacg

SEQ ID NO: 2254 - DNA, 19 bp, Artificial Sequence
  Description of Artificial Sequence: Chemically synthesized oligonucleotide
cgtgctgcgccgcggggag

SEQ ID NO: 2255 - DNA, 19 bp, Artificial Sequence
  Description of Artificial Sequence: Chemically synthesized oligonucleotide
tccccgcggcgcagcacgg

SEQ ID NO: 2256 - DNA, 19 bp, Artificial Sequence
  Description of Artificial Sequence: Chemically synthesized oligonucleotide
ccgtgctgcgccgcgggga

SEQ ID NO: 2257 - DNA, 19 bp, Artificial Sequence
  Description of Artificial Sequence: Chemically synthesized oligonucleotide
ccccgcggcgcagcacgga

SEQ ID NO: 2258 - DNA, 19 bp, Artificial Sequence
  Description of Artificial Sequence: Chemically synthesized oligonucleotide
tccgtgctgcgccgcgggg

SEQ ID NO: 2259 - DNA, 19 bp, Artificial Sequence
  Description of Artificial Sequence: Chemically synthesized oligonucleotide
cccgcggcgcagcacggag

SEQ ID NO: 2260 - DNA, 19 bp, Artificial Sequence
  Description of Artificial Sequence: Chemically synthesized oligonucleotide
ctccgtgctgcgccgcggg

SEQ ID NO: 2261 - DNA, 19 bp, Artificial Sequence
  Description of Artificial Sequence: Chemically synthesized oligonucleotide
ccgcggcgcagcacggagt

SEQ ID NO: 2262 - DNA, 19 bp, Artificial Sequence
  Description of Artificial Sequence: Chemically synthesized oligonucleotide
actccgtgctgcgccgcgg

SEQ ID NO: 2263 - DNA, 19 bp, Artificial Sequence
  Description of Artificial Sequence: Chemically synthesized oligonucleotide
cgcggcgcagcacggagtc

SEQ ID NO: 2264 - DNA, 19 bp, Artificial Sequence
  Description of Artificial Sequence: Chemically synthesized oligonucleotide
gactccgtgctgcgccgcg

SEQ ID NO: 2265 - DNA, 19 bp, Artificial Sequence
  Description of Artificial Sequence: Chemically synthesized oligonucleotide
gcggcgcagcacggagtct

SEQ ID NO: 2266 - DNA, 19 bp, Artificial Sequence
  Description of Artificial Sequence: Chemically synthesized oligonucleotide
agactccgtgctgcgccgc

SEQ ID NO: 2267 - DNA, 19 bp, Artificial Sequence
  Description of Artificial Sequence: Chemically synthesized oligonucleotide
cggcgcagcacggagtctc

SEQ ID NO: 2268 - DNA, 19 bp, Artificial Sequence
  Description of Artificial Sequence: Chemically synthesized oligonucleotide
gagactccgtgctgcgccg

SEQ ID NO: 2269 - DNA, 19 bp, Artificial Sequence
  Description of Artificial Sequence: Chemically synthesized oligonucleotide
ggcgcagcacggagtctcg

SEQ ID NO: 2270 - DNA, 19 bp, Artificial Sequence
  Description of Artificial Sequence: Chemically synthesized oligonucleotide
cgagactccgtgctgcgcc

SEQ ID NO: 2271 - DNA, 19 bp, Artificial Sequence
  Description of Artificial Sequence: Chemically synthesized oligonucleotide
gcgcagcacggagtctcgg

SEQ ID NO: 2272 - DNA, 19 bp, Artificial Sequence
  Description of Artificial Sequence: Chemically synthesized oligonucleotide
ccgagactccgtgctgcgc

SEQ ID NO: 2273 - DNA, 19 bp, Artificial Sequence
  Description of Artificial Sequence: Chemically synthesized oligonucleotide
cgcagcacggagtctcggc

SEQ ID NO: 2274 - DNA, 19 bp, Artificial Sequence
  Description of Artificial Sequence: Chemically synthesized oligonucleotide
gccgagactccgtgctgcg

SEQ ID NO: 2275 - DNA, 19 bp, Artificial Sequence
  Description of Artificial Sequence: Chemically synthesized oligonucleotide
gcagcacggagtctcggcg

SEQ ID NO: 2276 - DNA, 19 bp, Artificial Sequence
  Description of Artificial Sequence: Chemically synthesized oligonucleotide
cgccgagactccgtgctgc

SEQ ID NO: 2277 - DNA, 19 bp, Artificial Sequence
  Description of Artificial Sequence: Chemically synthesized oligonucleotide
cagcacggagtctcggcgt

SEQ ID NO: 2278 - DNA, 19 bp, Artificial Sequence
  Description of Artificial Sequence: Chemically synthesized oligonucleotide
acgccgagactccgtgctg

SEQ ID NO: 2279 - DNA, 19 bp, Artificial Sequence
  Description of Artificial Sequence: Chemically synthesized oligonucleotide
agcacggagtctcggcgtc

SEQ ID NO: 2280 - DNA, 19 bp, Artificial Sequence
  Description of Artificial Sequence: Chemically synthesized oligonucleotide
gacgccgagactccgtgct

SEQ ID NO: 2281 - DNA, 19 bp, Artificial Sequence
  Description of Artificial Sequence: Chemically synthesized oligonucleotide
gcacggagtctcggcgtcc

SEQ ID NO: 2282 - DNA, 19 bp, Artificial Sequence
  Description of Artificial Sequence: Chemically synthesized oligonucleotide
ggacgccgagactccgtgc

SEQ ID NO: 2283 - DNA, 19 bp, Artificial Sequence
  Description of Artificial Sequence: Chemically synthesized oligonucleotide
cacggagtctcggcgtccc

SEQ ID NO: 2284 - DNA, 19 bp, Artificial Sequence
  Description of Artificial Sequence: Chemically synthesized oligonucleotide
gggacgccgagactccgtg

SEQ ID NO: 2285 - DNA, 19 bp, Artificial Sequence
  Description of Artificial Sequence: Chemically synthesized oligonucleotide
acggagtctcggcgtccca

SEQ ID NO: 2286 - DNA, 19 bp, Artificial Sequence
  Description of Artificial Sequence: Chemically synthesized oligonucleotide
tgggacgccgagactccgt

SEQ ID NO: 2287 - DNA, 19 bp, Artificial Sequence
  Description of Artificial Sequence: Chemically synthesized oligonucleotide
cggagtctcggcgtcccat

SEQ ID NO: 2288 - DNA, 19 bp, Artificial Sequence
  Description of Artificial Sequence: Chemically synthesized oligonucleotide
atgggacgccgagactccg

SEQ ID NO: 2289 - DNA, 19 bp, Artificial Sequence
  Description of Artificial Sequence: Chemically synthesized oligonucleotide
ggagtctcggcgtcccatg

SEQ ID NO: 2290 - DNA, 19 bp, Artificial Sequence
  Description of Artificial Sequence: Chemically synthesized oligonucleotide
catgggacgccgagactcc

SEQ ID NO: 2291 - DNA, 19 bp, Artificial Sequence
  Description of Artificial Sequence: Chemically synthesized oligonucleotide
gagtctcggcgtcccatgg

SEQ ID NO: 2292 - DNA, 19 bp, Artificial Sequence
  Description of Artificial Sequence: Chemically synthesized oligonucleotide
ccatgggacgccgagactc

SEQ ID NO: 2293 - DNA, 19 bp, Artificial Sequence
  Description of Artificial Sequence: Chemically synthesized oligonucleotide
agtctcggcgtcccatggc

SEQ ID NO: 2294 - DNA, 19 bp, Artificial Sequence
  Description of Artificial Sequence: Chemically synthesized oligonucleotide
gccatgggacgccgagact

SEQ ID NO: 2295 - DNA, 19 bp, Artificial Sequence
  Description of Artificial Sequence: Chemically synthesized oligonucleotide
gtctcggcgtcccatggcg

SEQ ID NO: 2296 - DNA, 19 bp, Artificial Sequence
  Description of Artificial Sequence: Chemically synthesized oligonucleotide
cgccatgggacgccgagac

SEQ ID NO: 2297 - DNA, 19 bp, Artificial Sequence
  Description of Artificial Sequence: Chemically synthesized oligonucleotide
tctcggcgtcccatggcgc

SEQ ID NO: 2298 - DNA, 19 bp, Artificial Sequence
  Description of Artificial Sequence: Chemically synthesized oligonucleotide
gcgccatgggacgccgaga

SEQ ID NO: 2299 - DNA, 19 bp, Artificial Sequence
  Description of Artificial Sequence: Chemically synthesized oligonucleotide
ctcggcgtcccatggcgca

SEQ ID NO: 2300 - DNA, 19 bp, Artificial Sequence
  Description of Artificial Sequence: Chemically synthesized oligonucleotide
tgcgccatgggacgccgag

SEQ ID NO: 2301 - DNA, 19 bp, Artificial Sequence
  Description of Artificial Sequence: Chemically synthesized oligonucleotide
tcggcgtcccatggcgcaa

SEQ ID NO: 2302 - DNA, 19 bp, Artificial Sequence
  Description of Artificial Sequence: Chemically synthesized oligonucleotide
ttgcgccatgggacgccga

SEQ ID NO: 2303 - DNA, 19 bp, Artificial Sequence
  Description of Artificial Sequence: Chemically synthesized oligonucleotide
cggcgtcccatggcgcaac

SEQ ID NO: 2304 - DNA, 19 bp, Artificial Sequence
  Description of Artificial Sequence: Chemically synthesized oligonucleotide
gttgcgccatgggacgccg

SEQ ID NO: 2305 - DNA, 19 bp, Artificial Sequence
  Description of Artificial Sequence: Chemically synthesized oligonucleotide
ggcgtcccatggcgcaacc

SEQ ID NO: 2306 - DNA, 19 bp, Artificial Sequence
  Description of Artificial Sequence: Chemically synthesized oligonucleotide
ggttgcgccatgggacgcc

SEQ ID NO: 2307 - DNA, 19 bp, Artificial Sequence
  Description of Artificial Sequence: Chemically synthesized oligonucleotide
gcgtcccatggcgcaacct

SEQ ID NO: 2308 - DNA, 19 bp, Artificial Sequence
  Description of Artificial Sequence: Chemically synthesized oligonucleotide
aggttgcgccatgggacgc

SEQ ID NO: 2309 - DNA, 19 bp, Artificial Sequence
  Description of Artificial Sequence: Chemically synthesized oligonucleotide
cgtcccatggcgcaaccta

SEQ ID NO: 2310 - DNA, 19 bp, Artificial Sequence
  Description of Artificial Sequence: Chemically synthesized oligonucleotide
taggttgcgccatgggacg

SEQ ID NO: 2311 - DNA, 19 bp, Artificial Sequence
  Description of Artificial Sequence: Chemically synthesized oligonucleotide
gtcccatggcgcaacctac

SEQ ID NO: 2312 - DNA, 19 bp, Artificial Sequence
  Description of Artificial Sequence: Chemically synthesized oligonucleotide
gtaggttgcgccatgggac

SEQ ID NO: 2313 - DNA, 19 bp, Artificial Sequence
  Description of Artificial Sequence: Chemically synthesized oligonucleotide
tcccatggcgcaacctacg

SEQ ID NO: 2314 - DNA, 19 bp, Artificial Sequence
  Description of Artificial Sequence: Chemically synthesized oligonucleotide
cgtaggttgcgccatggga

SEQ ID NO: 2315 - DNA, 19 bp, Artificial Sequence
  Description of Artificial Sequence: Chemically synthesized oligonucleotide
cccatggcgcaacctacgg

SEQ ID NO: 2316 - DNA, 19 bp, Artificial Sequence
  Description of Artificial Sequence: Chemically synthesized oligonucleotide
ccgtaggttgcgccatggg

SEQ ID NO: 2317 - DNA, 19 bp, Artificial Sequence
  Description of Artificial Sequence: Chemically synthesized oligonucleotide
ccatggcgcaacctacggc

SEQ ID NO: 2318 - DNA, 19 bp, Artificial Sequence
  Description of Artificial Sequence: Chemically synthesized oligonucleotide
gccgtaggttgcgccatgg

SEQ ID NO: 2319 - DNA, 19 bp, Artificial Sequence
  Description of Artificial Sequence: Chemically synthesized oligonucleotide
catggcgcaacctacggcc

SEQ ID NO: 2320 - DNA, 19 bp, Artificial Sequence
  Description of Artificial Sequence: Chemically synthesized oligonucleotide
ggccgtaggttgcgccatg

SEQ ID NO: 2321 - DNA, 19 bp, Artificial Sequence
  Description of Artificial Sequence: Chemically synthesized oligonucleotide
atggcgcaacctacggcct

SEQ ID NO: 2322 - DNA, 19 bp, Artificial Sequence
  Description of Artificial Sequence: Chemically synthesized oligonucleotide
aggccgtaggttgcgccat

SEQ ID NO: 2323 - DNA, 19 bp, Artificial Sequence
  Description of Artificial Sequence: Chemically synthesized oligonucleotide
tggcgcaacctacggcctc

SEQ ID NO: 2324 - DNA, 19 bp, Artificial Sequence
  Description of Artificial Sequence: Chemically synthesized oligonucleotide
gaggccgtaggttgcgcca

SEQ ID NO: 2325 - DNA, 19 bp, Artificial Sequence
  Description of Artificial Sequence: Chemically synthesized oligonucleotide
ggcgcaacctacggcctcg

SEQ ID NO: 2326 - DNA, 19 bp, Artificial Sequence
  Description of Artificial Sequence: Chemically synthesized oligonucleotide
cgaggccgtaggttgcgcc

SEQ ID NO: 2327 - DNA, 19 bp, Artificial Sequence
  Description of Artificial Sequence: Chemically synthesized oligonucleotide
gcgcaacctacggcctcgg

SEQ ID NO: 2328 - DNA, 19 bp, Artificial Sequence
  Description of Artificial Sequence: Chemically synthesized oligonucleotide
ccgaggccgtaggttgcgc

SEQ ID NO: 2329 - DNA, 19 bp, Artificial Sequence
  Description of Artificial Sequence: Chemically synthesized oligonucleotide
cgcaacctacggcctcggc

SEQ ID NO: 2330 - DNA, 19 bp, Artificial Sequence
  Description of Artificial Sequence: Chemically synthesized oligonucleotide
gccgaggccgtaggttgcg

SEQ ID NO: 2331 - DNA, 19 bp, Artificial Sequence
  Description of Artificial Sequence: Chemically synthesized oligonucleotide
gcaacctacggcctcggcc

SEQ ID NO: 2332 - DNA, 19 bp, Artificial Sequence
  Description of Artificial Sequence: Chemically synthesized oligonucleotide
ggccgaggccgtaggttgc

SEQ ID NO: 2333 - DNA, 19 bp, Artificial Sequence
  Description of Artificial Sequence: Chemically synthesized oligonucleotide
caacctacggcctcggccc

SEQ ID NO: 2334 - DNA, 19 bp, Artificial Sequence
  Description of Artificial Sequence: Chemically synthesized oligonucleotide
gggccgaggccgtaggttg

SEQ ID NO: 2335 - DNA, 19 bp, Artificial Sequence
  Description of Artificial Sequence: Chemically synthesized oligonucleotide
aacctacggcctcggccca

SEQ ID NO: 2336 - DNA, 19 bp, Artificial Sequence
  Description of Artificial Sequence: Chemically synthesized oligonucleotide
tgggccgaggccgtaggtt

SEQ ID NO: 2337 - DNA, 19 bp, Artificial Sequence
  Description of Artificial Sequence: Chemically synthesized oligonucleotide
acctacggcctcggcccag

SEQ ID NO: 2338 - DNA, 19 bp, Artificial Sequence
  Description of Artificial Sequence: Chemically synthesized oligonucleotide
ctgggccgaggccgtaggt

SEQ ID NO: 2339 - DNA, 19 bp, Artificial Sequence
  Description of Artificial Sequence: Chemically synthesized oligonucleotide
cctacggcctcggcccaga

SEQ ID NO: 2340 - DNA, 19 bp, Artificial Sequence
  Description of Artificial Sequence: Chemically synthesized oligonucleotide
tctgggccgaggccgtagg

SEQ ID NO: 2341 - DNA, 19 bp, Artificial Sequence
  Description of Artificial Sequence: Chemically synthesized oligonucleotide
ctacggcctcggcccagaa

SEQ ID NO: 2342 - DNA, 19 bp, Artificial Sequence
  Description of Artificial Sequence: Chemically synthesized oligonucleotide
ttctgggccgaggccgtag

SEQ ID NO: 2343 - DNA, 19 bp, Artificial Sequence
  Description of Artificial Sequence: Chemically synthesized oligonucleotide
tacggcctcggcccagaag

SEQ ID NO: 2344 - DNA, 19 bp, Artificial Sequence
  Description of Artificial Sequence: Chemically synthesized oligonucleotide
cttctgggccgaggccgta

SEQ ID NO: 2345 - DNA, 19 bp, Artificial Sequence
  Description of Artificial Sequence: Chemically synthesized oligonucleotide
acggcctcggcccagaagc

SEQ ID NO: 2346 - DNA, 19 bp, Artificial Sequence
  Description of Artificial Sequence: Chemically synthesized oligonucleotide
gcttctgggccgaggccgt

SEQ ID NO: 2347 - DNA, 19 bp, Artificial Sequence
  Description of Artificial Sequence: Chemically synthesized oligonucleotide
cggcctcggcccagaagct

SEQ ID NO: 2348 - DNA, 19 bp, Artificial Sequence
  Description of Artificial Sequence: Chemically synthesized oligonucleotide
agcttctgggccgaggccg

SEQ ID NO: 2349 - DNA, 19 bp, Artificial Sequence
  Description of Artificial Sequence: Chemically synthesized oligonucleotide
ggcctcggcccagaagctg

SEQ ID NO: 2350 - DNA, 19 bp, Artificial Sequence
  Description of Artificial Sequence: Chemically synthesized oligonucleotide
cagcttctgggccgaggcc

SEQ ID NO: 2351 - DNA, 19 bp, Artificial Sequence
  Description of Artificial Sequence: Chemically synthesized oligonucleotide
gcctcggcccagaagctgg

SEQ ID NO: 2352 - DNA, 19 bp, Artificial Sequence
  Description of Artificial Sequence: Chemically synthesized oligonucleotide
ccagcttctgggccgaggc

SEQ ID NO: 2353 - DNA, 19 bp, Artificial Sequence
  Description of Artificial Sequence: Chemically synthesized oligonucleotide
cctcggcccagaagctggt

SEQ ID NO: 2354 - DNA, 19 bp, Artificial Sequence
  Description of Artificial Sequence: Chemically synthesized oligonucleotide
accagcttctgggccgagg

SEQ ID NO: 2355 - DNA, 19 bp, Artificial Sequence
  Description of Artificial Sequence: Chemically synthesized oligonucleotide
ctcggcccagaagctggtg

SEQ ID NO: 2356 - DNA, 19 bp, Artificial Sequence
  Description of Artificial Sequence: Chemically synthesized oligonucleotide
caccagcttctgggccgag

SEQ ID NO: 2357 - DNA, 19 bp, Artificial Sequence
  Description of Artificial Sequence: Chemically synthesized oligonucleotide
tcggcccagaagctggtgc

SEQ ID NO: 2358 - DNA, 19 bp, Artificial Sequence
  Description of Artificial Sequence: Chemically synthesized oligonucleotide
gcaccagcttctgggccga

SEQ ID NO: 2359 - DNA, 19 bp, Artificial Sequence
  Description of Artificial Sequence: Chemically synthesized oligonucleotide
cggcccagaagctggtgcg

SEQ ID NO: 2360 - DNA, 19 bp, Artificial Sequence
  Description of Artificial Sequence: Chemically synthesized oligonucleotide
cgcaccagcttctgggccg

SEQ ID NO: 2361 - DNA, 19 bp, Artificial Sequence
  Description of Artificial Sequence: Chemically synthesized oligonucleotide
ggcccagaagctggtgcgg

SEQ ID NO: 2362 - DNA, 19 bp, Artificial Sequence
  Description of Artificial Sequence: Chemically synthesized oligonucleotide
ccgcaccagcttctgggcc

SEQ ID NO: 2363 - DNA, 19 bp, Artificial Sequence
  Description of Artificial Sequence: Chemically synthesized oligonucleotide
gcccagaagctggtgcggc

SEQ ID NO: 2364 - DNA, 19 bp, Artificial Sequence
  Description of Artificial Sequence: Chemically synthesized oligonucleotide
gccgcaccagcttctgggc

SEQ ID NO: 2365 - DNA, 19 bp, Artificial Sequence
  Description of Artificial Sequence: Chemically synthesized oligonucleotide
cccagaagctggtgcggcc

SEQ ID NO: 2366 - DNA, 19 bp, Artificial Sequence
  Description of Artificial Sequence: Chemically synthesized oligonucleotide
ggccgcaccagcttctggg

SEQ ID NO: 2367 - DNA, 19 bp, Artificial Sequence
  Description of Artificial Sequence: Chemically synthesized oligonucleotide
ccagaagctggtgcggccg

SEQ ID NO: 2368 - DNA, 19 bp, Artificial Sequence
  Description of Artificial Sequence: Chemically synthesized oligonucleotide
cggccgcaccagcttctgg

SEQ ID NO: 2369 - DNA, 19 bp, Artificial Sequence
  Description of Artificial Sequence: Chemically synthesized oligonucleotide
cagaagctggtgcggccga

SEQ ID NO: 2370 - DNA, 19 bp, Artificial Sequence
  Description of Artificial Sequence: Chemically synthesized oligonucleotide
tcggccgcaccagcttctg

SEQ ID NO: 2371 - DNA, 19 bp, Artificial Sequence
  Description of Artificial Sequence: Chemically synthesized oligonucleotide
agaagctggtgcggccgat

SEQ ID NO: 2372 - DNA, 19 bp, Artificial Sequence
  Description of Artificial Sequence: Chemically synthesized oligonucleotide
atcggccgcaccagcttct

SEQ ID NO: 2373 - DNA, 19 bp, Artificial Sequence
  Description of Artificial Sequence: Chemically synthesized oligonucleotide
gaagctggtgcggccgatc

SEQ ID NO: 2374 - DNA, 19 bp, Artificial Sequence
  Description of Artificial Sequence: Chemically synthesized oligonucleotide
gatcggccgcaccagcttc

SEQ ID NO: 2375 - DNA, 19 bp, Artificial Sequence
  Description of Artificial Sequence: Chemically synthesized oligonucleotide
aagctggtgcggccgatcc

SEQ ID NO: 2376 - DNA, 19 bp, Artificial Sequence
  Description of Artificial Sequence: Chemically synthesized oligonucleotide
ggatcggccgcaccagctt

SEQ ID NO: 2377 - DNA, 19 bp, Artificial Sequence
  Description of Artificial Sequence: Chemically synthesized oligonucleotide
agctggtgcggccgatccg

SEQ ID NO: 2378 - DNA, 19 bp, Artificial Sequence
  Description of Artificial Sequence: Chemically synthesized oligonucleotide
cggatcggccgcaccagct

SEQ ID NO: 2379 - DNA, 19 bp, Artificial Sequence
  Description of Artificial Sequence: Chemically synthesized oligonucleotide
gctggtgcggccgatccgc

SEQ ID NO: 2380 - DNA, 19 bp, Artificial Sequence
  Description of Artificial Sequence: Chemically synthesized oligonucleotide
gcggatcggccgcaccagc

SEQ ID NO: 2381 - DNA, 19 bp, Artificial Sequence
  Description of Artificial Sequence: Chemically synthesized oligonucleotide
ctggtgcggccgatccgcg

SEQ ID NO: 2382 - DNA, 19 bp, Artificial Sequence
  Description of Artificial Sequence: Chemically synthesized oligonucleotide
cgcggatcggccgcaccag

SEQ ID NO: 2383 - DNA, 19 bp, Artificial Sequence
  Description of Artificial Sequence: Chemically synthesized oligonucleotide
tggtgcggccgatccgcgc

SEQ ID NO: 2384 - DNA, 19 bp, Artificial Sequence
  Description of Artificial Sequence: Chemically synthesized oligonucleotide
gcgcggatcggccgcacca

SEQ ID NO: 2385 - DNA, 19 bp, Artificial Sequence
  Description of Artificial Sequence: Chemically synthesized oligonucleotide
ggtgcggccgatccgcgcc

SEQ ID NO: 2386 - DNA, 19 bp, Artificial Sequence
  Description of Artificial Sequence: Chemically synthesized oligonucleotide
ggcgcggatcggccgcacc

SEQ ID NO: 2387 - DNA, 19 bp, Artificial Sequence
  Description of Artificial Sequence: Chemically synthesized oligonucleotide
gtgcggccgatccgcgccg

SEQ ID NO: 2388 - DNA, 19 bp, Artificial Sequence
  Description of Artificial Sequence: Chemically synthesized oligonucleotide
cggcgcggatcggccgcac

SEQ ID NO: 2389 - DNA, 19 bp, Artificial Sequence
  Description of Artificial Sequence: Chemically synthesized oligonucleotide
tgcggccgatccgcgccgt

SEQ ID NO: 2390 - DNA, 19 bp, Artificial Sequence
  Description of Artificial Sequence: Chemically synthesized oligonucleotide
acggcgcggatcggccgca

SEQ ID NO: 2391 - DNA, 19 bp, Artificial Sequence
  Description of Artificial Sequence: Chemically synthesized oligonucleotide
gcggccgatccgcgccgtg

SEQ ID NO: 2392 - DNA, 19 bp, Artificial Sequence
  Description of Artificial Sequence: Chemically synthesized oligonucleotide
cacggcgcggatcggccgc

SEQ ID NO: 2393 - DNA, 19 bp, Artificial Sequence
  Description of Artificial Sequence: Chemically synthesized oligonucleotide
cggccgatccgcgccgtgt

SEQ ID NO: 2394 - DNA, 19 bp, Artificial Sequence
  Description of Artificial Sequence: Chemically synthesized oligonucleotide
acacggcgcggatcggccg

SEQ ID NO: 2395 - DNA, 19 bp, Artificial Sequence
  Description of Artificial Sequence: Chemically synthesized oligonucleotide
ggccgatccgcgccgtgtg

SEQ ID NO: 2396 - DNA, 19 bp, Artificial Sequence
  Description of Artificial Sequence: Chemically synthesized oligonucleotide
cacacggcgcggatcggcc

SEQ ID NO: 2397 - DNA, 19 bp, Artificial Sequence
  Description of Artificial Sequence: Chemically synthesized oligonucleotide
gccgatccgcgccgtgtgc

SEQ ID NO: 2398 - DNA, 19 bp, Artificial Sequence
  Description of Artificial Sequence: Chemically synthesized oligonucleotide
gcacacggcgcggatcggc

SEQ ID NO: 2399 - DNA, 19 bp, Artificial Sequence
  Description of Artificial Sequence: Chemically synthesized oligonucleotide
ccgatccgcgccgtgtgcc

SEQ ID NO: 2400 - DNA, 19 bp, Artificial Sequence
  Description of Artificial Sequence: Chemically synthesized oligonucleotide
ggcacacggcgcggatcgg

SEQ ID NO: 2401 - DNA, 19 bp, Artificial Sequence
  Description of Artificial Sequence: Chemically synthesized oligonucleotide
cgatccgcgccgtgtgccg

SEQ ID NO: 2402 - DNA, 19 bp, Artificial Sequence
  Description of Artificial Sequence: Chemically synthesized oligonucleotide
cggcacacggcgcggatcg

SEQ ID NO: 2403 - DNA, 19 bp, Artificial Sequence
  Description of Artificial Sequence: Chemically synthesized oligonucleotide
gatccgcgccgtgtgccgc

SEQ ID NO: 2404 - DNA, 19 bp, Artificial Sequence
  Description of Artificial Sequence: Chemically synthesized oligonucleotide
gcggcacacggcgcggatc

SEQ ID NO: 2405 - DNA, 19 bp, Artificial Sequence
  Description of Artificial Sequence: Chemically synthesized oligonucleotide
atccgcgccgtgtgccgca

SEQ ID NO: 2406 - DNA, 19 bp, Artificial Sequence
  Description of Artificial Sequence: Chemically synthesized oligonucleotide
tgcggcacacggcgcggat

SEQ ID NO: 2407 - DNA, 19 bp, Artificial Sequence
  Description of Artificial Sequence: Chemically synthesized oligonucleotide
tccgcgccgtgtgccgcat

SEQ ID NO: 2408 - DNA, 19 bp, Artificial Sequence
  Description of Artificial Sequence: Chemically synthesized oligonucleotide
atgcggcacacggcgcgga

SEQ ID NO: 2409 - DNA, 19 bp, Artificial Sequence
  Description of Artificial Sequence: Chemically synthesized oligonucleotide
ccgcgccgtgtgccgcatc

SEQ ID NO: 2410 - DNA, 19 bp, Artificial Sequence
  Description of Artificial Sequence: Chemically synthesized oligonucleotide
gatgcggcacacggcgcgg

SEQ ID NO: 2411 - DNA, 19 bp, Artificial Sequence
  Description of Artificial Sequence: Chemically synthesized oligonucleotide
cgcgccgtgtgccgcatcc

SEQ ID NO: 2412 - DNA, 19 bp, Artificial Sequence
  Description of Artificial Sequence: Chemically synthesized oligonucleotide
ggatgcggcacacggcgcg

SEQ ID NO: 2413 - DNA, 19 bp, Artificial Sequence
  Description of Artificial Sequence: Chemically synthesized oligonucleotide
gcgccgtgtgccgcatcct

SEQ ID NO: 2414 - DNA, 19 bp, Artificial Sequence
  Description of Artificial Sequence: Chemically synthesized oligonucleotide
aggatgcggcacacggcgc

SEQ ID NO: 2415 - DNA, 19 bp, Artificial Sequence
  Description of Artificial Sequence: Chemically synthesized oligonucleotide
cgccgtgtgccgcatcctg

SEQ ID NO: 2416 - DNA, 19 bp, Artificial Sequence
  Description of Artificial Sequence: Chemically synthesized oligonucleotide
caggatgcggcacacggcg

SEQ ID NO: 2417 - DNA, 19 bp, Artificial Sequence
  Description of Artificial Sequence: Chemically synthesized oligonucleotide
gccgtgtgccgcatcctgc

SEQ ID NO: 2418 - DNA, 19 bp, Artificial Sequence
  Description of Artificial Sequence: Chemically synthesized oligonucleotide
gcaggatgcggcacacggc

SEQ ID NO: 2419 - DNA, 19 bp, Artificial Sequence
  Description of Artificial Sequence: Chemically synthesized oligonucleotide
ccgtgtgccgcatcctgca

SEQ ID NO: 2420 - DNA, 19 bp, Artificial Sequence
  Description of Artificial Sequence: Chemically synthesized oligonucleotide
tgcaggatgcggcacacgg

SEQ ID NO: 2421 - DNA, 19 bp, Artificial Sequence
  Description of Artificial Sequence: Chemically synthesized oligonucleotide
cgtgtgccgcatcctgcag

SEQ ID NO: 2422 - DNA, 19 bp, Artificial Sequence
  Description of Artificial Sequence: Chemically synthesized oligonucleotide
ctgcaggatgcggcacacg

SEQ ID NO: 2423 - DNA, 19 bp, Artificial Sequence
  Description of Artificial Sequence: Chemically synthesized oligonucleotide
gtgtgccgcatcctgcaga

SEQ ID NO: 2424 - DNA, 19 bp, Artificial Sequence
  Description of Artificial Sequence: Chemically synthesized oligonucleotide
tctgcaggatgcggcacac

SEQ ID NO: 2425 - DNA, 19 bp, Artificial Sequence
  Description of Artificial Sequence: Chemically synthesized oligonucleotide
tgtgccgcatcctgcagat

SEQ ID NO: 2426 - DNA, 19 bp, Artificial Sequence
  Description of Artificial Sequence: Chemically synthesized oligonucleotide
atctgcaggatgcggcaca

SEQ ID NO: 2427 - DNA, 19 bp, Artificial Sequence
  Description of Artificial Sequence: Chemically synthesized oligonucleotide
gtgccgcatcctgcagatc

SEQ ID NO: 2428 - DNA, 19 bp, Artificial Sequence
  Description of Artificial Sequence: Chemically synthesized oligonucleotide
gatctgcaggatgcggcac

SEQ ID NO: 2429 - DNA, 19 bp, Artificial Sequence
  Description of Artificial Sequence: Chemically synthesized oligonucleotide
tgccgcatcctgcagatcc

SEQ ID NO: 2430 - DNA, 19 bp, Artificial Sequence
  Description of Artificial Sequence: Chemically synthesized oligonucleotide
ggatctgcaggatgcggca

SEQ ID NO: 2431 - DNA, 19 bp, Artificial Sequence
  Description of Artificial Sequence: Chemically synthesized oligonucleotide
gccgcatcctgcagatccc

SEQ ID NO: 2432 - DNA, 19 bp, Artificial Sequence
  Description of Artificial Sequence: Chemically synthesized oligonucleotide
gggatctgcaggatgcggc

SEQ ID NO: 2433 - DNA, 19 bp, Artificial Sequence
  Description of Artificial Sequence: Chemically synthesized oligonucleotide
ccgcatcctgcagatcccg

SEQ ID NO: 2434 - DNA, 19 bp, Artificial Sequence
  Description of Artificial Sequence: Chemically synthesized oligonucleotide
cgggatctgcaggatgcgg

SEQ ID NO: 2435 - DNA, 19 bp, Artificial Sequence
  Description of Artificial Sequence: Chemically synthesized oligonucleotide
cgcatcctgcagatcccgg

SEQ ID NO: 2436 - DNA, 19 bp, Artificial Sequence
  Description of Artificial Sequence: Chemically synthesized oligonucleotide
ccgggatctgcaggatgcg

SEQ ID NO: 2437 - DNA, 19 bp, Artificial Sequence
  Description of Artificial Sequence: Chemically synthesized oligonucleotide
gcatcctgcagatcccgga

SEQ ID NO: 2438 - DNA, 19 bp, Artificial Sequence
  Description of Artificial Sequence: Chemically synthesized oligonucleotide
tccgggatctgcaggatgc

SEQ ID NO: 2439 - DNA, 19 bp, Artificial Sequence
  Description of Artificial Sequence: Chemically synthesized oligonucleotide
catcctgcagatcccggag

SEQ ID NO: 2440 - DNA, 19 bp, Artificial Sequence
  Description of Artificial Sequence: Chemically synthesized oligonucleotide
ctccgggatctgcaggatg

SEQ ID NO: 2441 - DNA, 19 bp, Artificial Sequence
  Description of Artificial Sequence: Chemically synthesized oligonucleotide
atcctgcagatcccggagt

SEQ ID NO: 2442 - DNA, 19 bp, Artificial Sequence
  Description of Artificial Sequence: Chemically synthesized oligonucleotide
actccgggatctgcaggat

SEQ ID NO: 2443 - DNA, 19 bp, Artificial Sequence
  Description of Artificial Sequence: Chemically synthesized oligonucleotide
tcctgcagatcccggagtc

SEQ ID NO: 2444 - DNA, 19 bp, Artificial Sequence
  Description of Artificial Sequence: Chemically synthesized oligonucleotide
gactccgggatctgcagga

SEQ ID NO: 2445 - DNA, 19 bp, Artificial Sequence
  Description of Artificial Sequence: Chemically synthesized oligonucleotide
cctgcagatcccggagtcc

SEQ ID NO: 2446 - DNA, 19 bp, Artificial Sequence
  Description of Artificial Sequence: Chemically synthesized oligonucleotide
ggactccgggatctgcagg

SEQ ID NO: 2447 - DNA, 19 bp, Artificial Sequence
  Description of Artificial Sequence: Chemically synthesized oligonucleotide
ctgcagatcccggagtccg

SEQ ID NO: 2448 - DNA, 19 bp, Artificial Sequence
  Description of Artificial Sequence: Chemically synthesized oligonucleotide
cggactccgggatctgcag

SEQ ID NO: 2449 - DNA, 19 bp, Artificial Sequence
  Description of Artificial Sequence: Chemically synthesized oligonucleotide
tgcagatcccggagtccga

SEQ ID NO: 2450 - DNA, 19 bp, Artificial Sequence
  Description of Artificial Sequence: Chemically synthesized oligonucleotide
tcggactccgggatctgca

SEQ ID NO: 2451 - DNA, 19 bp, Artificial Sequence
  Description of Artificial Sequence: Chemically synthesized oligonucleotide
gcagatcccggagtccgac

SEQ ID NO: 2452 - DNA, 19 bp, Artificial Sequence
  Description of Artificial Sequence: Chemically synthesized oligonucleotide
gtcggactccgggatctgc

SEQ ID NO: 2453 - DNA, 19 bp, Artificial Sequence
  Description of Artificial Sequence: Chemically synthesized oligonucleotide
cagatcccggagtccgacc

SEQ ID NO: 2454 - DNA, 19 bp, Artificial Sequence
  Description of Artificial Sequence: Chemically synthesized oligonucleotide
ggtcggactccgggatctg

SEQ ID NO: 2455 - DNA, 19 bp, Artificial Sequence
  Description of Artificial Sequence: Chemically synthesized oligonucleotide
agatcccggagtccgaccc

SEQ ID NO: 2456 - DNA, 19 bp, Artificial Sequence
  Description of Artificial Sequence: Chemically synthesized oligonucleotide
gggtcggactccgggatct

SEQ ID NO: 2457 - DNA, 19 bp, Artificial Sequence
  Description of Artificial Sequence: Chemically synthesized oligonucleotide
gatcccggagtccgacccc

SEQ ID NO: 2458 - DNA, 19 bp, Artificial Sequence
  Description of Artificial Sequence: Chemically synthesized oligonucleotide
ggggtcggactccgggatc

SEQ ID NO: 2459 - DNA, 19 bp, Artificial Sequence
  Description of Artificial Sequence: Chemically synthesized oligonucleotide
atcccggagtccgacccct

SEQ ID NO: 2460 - DNA, 19 bp, Artificial Sequence
  Description of Artificial Sequence: Chemically synthesized oligonucleotide
aggggtcggactccgggat

SEQ ID NO: 2461 - DNA, 19 bp, Artificial Sequence
  Description of Artificial Sequence: Chemically synthesized oligonucleotide
tcccggagtccgacccctc

SEQ ID NO: 2462 - DNA, 19 bp, Artificial Sequence
  Description of Artificial Sequence: Chemically synthesized oligonucleotide
gaggggtcggactccggga

SEQ ID NO: 2463 - DNA, 19 bp, Artificial Sequence
  Description of Artificial Sequence: Chemically synthesized oligonucleotide
cccggagtccgacccctcc

SEQ ID NO: 2464 - DNA, 19 bp, Artificial Sequence
  Description of Artificial Sequence: Chemically synthesized oligonucleotide
ggaggggtcggactccggg

SEQ ID NO: 2465 - DNA, 19 bp, Artificial Sequence
  Description of Artificial Sequence: Chemically synthesized oligonucleotide
ccggagtccgacccctcca

SEQ ID NO: 2466 - DNA, 19 bp, Artificial Sequence
  Description of Artificial Sequence: Chemically synthesized oligonucleotide
tggaggggtcggactccgg

SEQ ID NO: 2467 - DNA, 19 bp, Artificial Sequence
  Description of Artificial Sequence: Chemically synthesized oligonucleotide
cggagtccgacccctccaa

SEQ ID NO: 2468 - DNA, 19 bp, Artificial Sequence
  Description of Artificial Sequence: Chemically synthesized oligonucleotide
ttggaggggtcggactccg

SEQ ID NO: 2469 - DNA, 19 bp, Artificial Sequence
  Description of Artificial Sequence: Chemically synthesized oligonucleotide
ggagtccgacccctccaac

SEQ ID NO: 2470 - DNA, 19 bp, Artificial Sequence
  Description of Artificial Sequence: Chemically synthesized oligonucleotide
gttggaggggtcggactcc

SEQ ID NO: 2471 - DNA, 19 bp, Artificial Sequence
  Description of Artificial Sequence: Chemically synthesized oligonucleotide
gagtccgacccctccaacc

SEQ ID NO: 2472 - DNA, 19 bp, Artificial Sequence
  Description of Artificial Sequence: Chemically synthesized oligonucleotide
ggttggaggggtcggactc

SEQ ID NO: 2473 - DNA, 19 bp, Artificial Sequence
  Description of Artificial Sequence: Chemically synthesized oligonucleotide
agtccgacccctccaacct

SEQ ID NO: 2474 - DNA, 19 bp, Artificial Sequence
  Description of Artificial Sequence: Chemically synthesized oligonucleotide
aggttggaggggtcggact

SEQ ID NO: 2475 - DNA, 19 bp, Artificial Sequence
  Description of Artificial Sequence: Chemically synthesized oligonucleotide
gtccgacccctccaacctg

SEQ ID NO: 2476 - DNA, 19 bp, Artificial Sequence
  Description of Artificial Sequence: Chemically synthesized oligonucleotide
caggttggaggggtcggac

SEQ ID NO: 2477 - DNA, 19 bp, Artificial Sequence
  Description of Artificial Sequence: Chemically synthesized oligonucleotide
tccgacccctccaacctgc

SEQ ID NO: 2478 - DNA, 19 bp, Artificial Sequence
  Description of Artificial Sequence: Chemically synthesized oligonucleotide
gcaggttggaggggtcgga

SEQ ID NO: 2479 - DNA, 19 bp, Artificial Sequence
  Description of Artificial Sequence: Chemically synthesized oligonucleotide
ccgacccctccaacctgcg

SEQ ID NO: 2480 - DNA, 19 bp, Artificial Sequence
  Description of Artificial Sequence: Chemically synthesized oligonucleotide
cgcaggttggaggggtcgg

SEQ ID NO: 2481 - DNA, 19 bp, Artificial Sequence
  Description of Artificial Sequence: Chemically synthesized oligonucleotide
cgacccctccaacctgcgg

SEQ ID NO: 2482 - DNA, 19 bp, Artificial Sequence
  Description of Artificial Sequence: Chemically synthesized oligonucleotide
ccgcaggttggaggggtcg

SEQ ID NO: 2483 - DNA, 19 bp, Artificial Sequence
  Description of Artificial Sequence: Chemically synthesized oligonucleotide
gacccctccaacctgcggc

SEQ ID NO: 2484 - DNA, 19 bp, Artificial Sequence
  Description of Artificial Sequence: Chemically synthesized oligonucleotide
gccgcaggttggaggggtc

SEQ ID NO: 2485 - DNA, 19 bp, Artificial Sequence
  Description of Artificial Sequence: Chemically synthesized oligonucleotide
acccctccaacctgcggcc

SEQ ID NO: 2486 - DNA, 19 bp, Artificial Sequence
  Description of Artificial Sequence: Chemically synthesized oligonucleotide
ggccgcaggttggaggggt

SEQ ID NO: 2487 - DNA, 19 bp, Artificial Sequence
  Description of Artificial Sequence: Chemically synthesized oligonucleotide
cccctccaacctgcggccc

SEQ ID NO: 2488 - DNA, 19 bp, Artificial Sequence
  Description of Artificial Sequence: Chemically synthesized oligonucleotide
gggccgcaggttggagggg

SEQ ID NO: 2489 - DNA, 19 bp, Artificial Sequence
  Description of Artificial Sequence: Chemically synthesized oligonucleotide
ccctccaacctgcggccct

SEQ ID NO: 2490 - DNA, 19 bp, Artificial Sequence
  Description of Artificial Sequence: Chemically synthesized oligonucleotide
agggccgcaggttggaggg

SEQ ID NO: 2491 - DNA, 19 bp, Artificial Sequence
  Description of Artificial Sequence: Chemically synthesized oligonucleotide
cctccaacctgcggcccta

SEQ ID NO: 2492 - DNA, 19 bp, Artificial Sequence
  Description of Artificial Sequence: Chemically synthesized oligonucleotide
tagggccgcaggttggagg

SEQ ID NO: 2493 - DNA, 19 bp, Artificial Sequence
  Description of Artificial Sequence: Chemically synthesized oligonucleotide
ctccaacctgcggccctag

SEQ ID NO: 2494 - DNA, 19 bp, Artificial Sequence
  Description of Artificial Sequence: Chemically synthesized oligonucleotide
ctagggccgcaggttggag

SEQ ID NO: 2495 - DNA, 19 bp, Artificial Sequence
  Description of Artificial Sequence: Chemically synthesized oligonucleotide
tccaacctgcggccctaga

SEQ ID NO: 2496 - DNA, 19 bp, Artificial Sequence
  Description of Artificial Sequence: Chemically synthesized oligonucleotide
tctagggccgcaggttgga

SEQ ID NO: 2497 - DNA, 19 bp, Artificial Sequence
  Description of Artificial Sequence: Chemically synthesized oligonucleotide
ccaacctgcggccctagag

SEQ ID NO: 2498 - DNA, 19 bp, Artificial Sequence
  Description of Artificial Sequence: Chemically synthesized oligonucleotide
ctctagggccgcaggttgg

SEQ ID NO: 2499 - DNA, 19 bp, Artificial Sequence
  Description of Artificial Sequence: Chemically synthesized oligonucleotide
caacctgcggccctagagc

SEQ ID NO: 2500 - DNA, 19 bp, Artificial Sequence
  Description of Artificial Sequence: Chemically synthesized oligonucleotide
gctctagggccgcaggttg

SEQ ID NO: 2501 - DNA, 19 bp, Artificial Sequence
  Description of Artificial Sequence: Chemically synthesized oligonucleotide
aacctgcggccctagagcg

SEQ ID NO: 2502 - DNA, 19 bp, Artificial Sequence
  Description of Artificial Sequence: Chemically synthesized oligonucleotide
cgctctagggccgcaggtt

SEQ ID NO: 2503 - DNA, 19 bp, Artificial Sequence
  Description of Artificial Sequence: Chemically synthesized oligonucleotide
acctgcggccctagagcgc

SEQ ID NO: 2504 - DNA, 19 bp, Artificial Sequence
  Description of Artificial Sequence: Chemically synthesized oligonucleotide
gcgctctagggccgcaggt

SEQ ID NO: 2505 - DNA, 19 bp, Artificial Sequence
  Description of Artificial Sequence: Chemically synthesized oligonucleotide
cctgcggccctagagcgcc

SEQ ID NO: 2506 - DNA, 19 bp, Artificial Sequence
  Description of Artificial Sequence: Chemically synthesized oligonucleotide
ggcgctctagggccgcagg

SEQ ID NO: 2507 - DNA, 19 bp, Artificial Sequence
  Description of Artificial Sequence: Chemically synthesized oligonucleotide
ctgcggccctagagcgccc

SEQ ID NO: 2508 - DNA, 19 bp, Artificial Sequence
  Description of Artificial Sequence: Chemically synthesized oligonucleotide
gggcgctctagggccgcag

SEQ ID NO: 2509 - DNA, 19 bp, Artificial Sequence
  Description of Artificial Sequence: Chemically synthesized oligonucleotide
tgcggccctagagcgcccc

SEQ ID NO: 2510 - DNA, 19 bp, Artificial Sequence
  Description of Artificial Sequence: Chemically synthesized oligonucleotide
ggggcgctctagggccgca

SEQ ID NO: 2511 - DNA, 19 bp, Artificial Sequence
  Description of Artificial Sequence: Chemically synthesized oligonucleotide
gcggccctagagcgccccc

SEQ ID NO: 2512 - DNA, 19 bp, Artificial Sequence
  Description of Artificial Sequence: Chemically synthesized oligonucleotide
gggggcgctctagggccgc

SEQ ID NO: 2513 - DNA, 19 bp, Artificial Sequence
  Description of Artificial Sequence: Chemically synthesized oligonucleotide
cggccctagagcgcccccg

SEQ ID NO: 2514 - DNA, 19 bp, Artificial Sequence
  Description of Artificial Sequence: Chemically synthesized oligonucleotide
cgggggcgctctagggccg

SEQ ID NO: 2515 - DNA, 19 bp, Artificial Sequence
  Description of Artificial Sequence: Chemically synthesized oligonucleotide
ggccctagagcgcccccgc

SEQ ID NO: 2516 - DNA, 19 bp, Artificial Sequence
  Description of Artificial Sequence: Chemically synthesized oligonucleotide
gcgggggcgctctagggcc

SEQ ID NO: 2517 - DNA, 19 bp, Artificial Sequence
  Description of Artificial Sequence: Chemically synthesized oligonucleotide
gccctagagcgcccccgcc

SEQ ID NO: 2518 - DNA, 19 bp, Artificial Sequence
  Description of Artificial Sequence: Chemically synthesized oligonucleotide
ggcgggggcgctctagggc

SEQ ID NO: 2519 - DNA, 19 bp, Artificial Sequence
  Description of Artificial Sequence: Chemically synthesized oligonucleotide
ccctagagcgcccccgccg

SEQ ID NO: 2520 - DNA, 19 bp, Artificial Sequence
  Description of Artificial Sequence: Chemically synthesized oligonucleotide
cggcgggggcgctctaggg

SEQ ID NO: 2521 - DNA, 19 bp, Artificial Sequence
  Description of Artificial Sequence: Chemically synthesized oligonucleotide
cctagagcgcccccgccgc

SEQ ID NO: 2522 - DNA, 19 bp, Artificial Sequence
  Description of Artificial Sequence: Chemically synthesized oligonucleotide
gcggcgggggcgctctagg

SEQ ID NO: 2523 - DNA, 19 bp, Artificial Sequence
  Description of Artificial Sequence: Chemically synthesized oligonucleotide
ctagagcgcccccgccgcc

SEQ ID NO: 2524 - DNA, 19 bp, Artificial Sequence
  Description of Artificial Sequence: Chemically synthesized oligonucleotide
ggcggcgggggcgctctag

SEQ ID NO: 2525 - DNA, 19 bp, Artificial Sequence
  Description of Artificial Sequence: Chemically synthesized oligonucleotide
tagagcgcccccgccgccc

SEQ ID NO: 2526 - DNA, 19 bp, Artificial Sequence
  Description of Artificial Sequence: Chemically synthesized oligonucleotide
gggcggcgggggcgctcta

SEQ ID NO: 2527 - DNA, 19 bp, Artificial Sequence
  Description of Artificial Sequence: Chemically synthesized oligonucleotide
agagcgcccccgccgcccc

SEQ ID NO: 2528 - DNA, 19 bp, Artificial Sequence
  Description of Artificial Sequence: Chemically synthesized oligonucleotide
ggggcggcgggggcgctct

SEQ ID NO: 2529 - DNA, 19 bp, Artificial Sequence
  Description of Artificial Sequence: Chemically synthesized oligonucleotide
gagcgcccccgccgccccg

SEQ ID NO: 2530 - DNA, 19 bp, Artificial Sequence
  Description of Artificial Sequence: Chemically synthesized oligonucleotide
cggggcggcgggggcgctc

SEQ ID NO: 2531 - DNA, 19 bp, Artificial Sequence
  Description of Artificial Sequence: Chemically synthesized oligonucleotide
agcgcccccgccgccccgg

SEQ ID NO: 2532 - DNA, 19 bp, Artificial Sequence
  Description of Artificial Sequence: Chemically synthesized oligonucleotide
ccggggcggcgggggcgct

SEQ ID NO: 2533 - DNA, 19 bp, Artificial Sequence
  Description of Artificial Sequence: Chemically synthesized oligonucleotide
gcgcccccgccgccccggg

SEQ ID NO: 2534 - DNA, 19 bp, Artificial Sequence
  Description of Artificial Sequence: Chemically synthesized oligonucleotide
cccggggcggcgggggcgc

SEQ ID NO: 2535 - DNA, 19 bp, Artificial Sequence
  Description of Artificial Sequence: Chemically synthesized oligonucleotide
cgcccccgccgccccgggg

SEQ ID NO: 2536 - DNA, 19 bp, Artificial Sequence
  Description of Artificial Sequence: Chemically synthesized oligonucleotide
ccccggggcggcgggggcg

SEQ ID NO: 2537 - DNA, 19 bp, Artificial Sequence
  Description of Artificial Sequence: Chemically synthesized oligonucleotide
gcccccgccgccccggggg

SEQ ID NO: 2538 - DNA, 19 bp, Artificial Sequence
  Description of Artificial Sequence: Chemically synthesized oligonucleotide
cccccggggcggcgggggc

SEQ ID NO: 2539 - DNA, 19 bp, Artificial Sequence
  Description of Artificial Sequence: Chemically synthesized oligonucleotide
cccccgccgccccggggga

SEQ ID NO: 2540 - DNA, 19 bp, Artificial Sequence
  Description of Artificial Sequence: Chemically synthesized oligonucleotide
tcccccggggcggcggggg

SEQ ID NO: 2541 - DNA, 19 bp, Artificial Sequence
  Description of Artificial Sequence: Chemically synthesized oligonucleotide
ccccgccgccccgggggaa

SEQ ID NO: 2542 - DNA, 19 bp, Artificial Sequence
  Description of Artificial Sequence: Chemically synthesized oligonucleotide
ttcccccggggcggcgggg

SEQ ID NO: 2543 - DNA, 19 bp, Artificial Sequence
  Description of Artificial Sequence: Chemically synthesized oligonucleotide
cccgccgccccgggggaag

SEQ ID NO: 2544 - DNA, 19 bp, Artificial Sequence
  Description of Artificial Sequence: Chemically synthesized oligonucleotide
cttcccccggggcggcggg

SEQ ID NO: 2545 - DNA, 19 bp, Artificial Sequence
  Description of Artificial Sequence: Chemically synthesized oligonucleotide
ccgccgccccgggggaagg

SEQ ID NO: 2546 - DNA, 19 bp, Artificial Sequence
  Description of Artificial Sequence: Chemically synthesized oligonucleotide
ccttcccccggggcggcgg

SEQ ID NO: 2547 - DNA, 19 bp, Artificial Sequence
  Description of Artificial Sequence: Chemically synthesized oligonucleotide
cgccgccccgggggaagga

SEQ ID NO: 2548 - DNA, 19 bp, Artificial Sequence
  Description of Artificial Sequence: Chemically synthesized oligonucleotide
tccttcccccggggcggcg

SEQ ID NO: 2549 - DNA, 19 bp, Artificial Sequence
  Description of Artificial Sequence: Chemically synthesized oligonucleotide
gccgccccgggggaaggag

SEQ ID NO: 2550 - DNA, 19 bp, Artificial Sequence
  Description of Artificial Sequence: Chemically synthesized oligonucleotide
ctccttcccccggggcggc

SEQ ID NO: 2551 - DNA, 19 bp, Artificial Sequence
  Description of Artificial Sequence: Chemically synthesized oligonucleotide
ccgccccgggggaaggaga

SEQ ID NO: 2552 - DNA, 19 bp, Artificial Sequence
  Description of Artificial Sequence: Chemically synthesized oligonucleotide
tctccttcccccggggcgg

SEQ ID NO: 2553 - DNA, 19 bp, Artificial Sequence
  Description of Artificial Sequence: Chemically synthesized oligonucleotide
cgccccgggggaaggagag

SEQ ID NO: 2554 - DNA, 19 bp, Artificial Sequence
  Description of Artificial Sequence: Chemically synthesized oligonucleotide
ctctccttcccccggggcg

SEQ ID NO: 2555 - DNA, 19 bp, Artificial Sequence
  Description of Artificial Sequence: Chemically synthesized oligonucleotide
gccccgggggaaggagagc

SEQ ID NO: 2556 - DNA, 19 bp, Artificial Sequence
  Description of Artificial Sequence: Chemically synthesized oligonucleotide
gctctccttcccccggggc

SEQ ID NO: 2557 - DNA, 19 bp, Artificial Sequence
  Description of Artificial Sequence: Chemically synthesized oligonucleotide
ccccgggggaaggagagcg

SEQ ID NO: 2558 - DNA, 19 bp, Artificial Sequence
  Description of Artificial Sequence: Chemically synthesized oligonucleotide
cgctctccttcccccgggg

SEQ ID NO: 2559 - DNA, 19 bp, Artificial Sequence
  Description of Artificial Sequence: Chemically synthesized oligonucleotide
cccgggggaaggagagcgc

SEQ ID NO: 2560 - DNA, 19 bp, Artificial Sequence
  Description of Artificial Sequence: Chemically synthesized oligonucleotide
gcgctctccttcccccggg

SEQ ID NO: 2561 - DNA, 19 bp, Artificial Sequence
  Description of Artificial Sequence: Chemically synthesized oligonucleotide
ccgggggaaggagagcgcg

SEQ ID NO: 2562 - DNA, 19 bp, Artificial Sequence
  Description of Artificial Sequence: Chemically synthesized oligonucleotide
cgcgctctccttcccccgg

SEQ ID NO: 2563 - DNA, 19 bp, Artificial Sequence
  Description of Artificial Sequence: Chemically synthesized oligonucleotide
cgggggaaggagagcgcga

SEQ ID NO: 2564 - DNA, 19 bp, Artificial Sequence
  Description of Artificial Sequence: Chemically synthesized oligonucleotide
tcgcgctctccttcccccg

SEQ ID NO: 2565 - DNA, 19 bp, Artificial Sequence
  Description of Artificial Sequence: Chemically synthesized oligonucleotide
gggggaaggagagcgcgag

SEQ ID NO: 2566 - DNA, 19 bp, Artificial Sequence
  Description of Artificial Sequence: Chemically synthesized oligonucleotide
ctcgcgctctccttccccc

SEQ ID NO: 2567 - DNA, 19 bp, Artificial Sequence
  Description of Artificial Sequence: Chemically synthesized oligonucleotide
ggggaaggagagcgcgagc

SEQ ID NO: 2568 - DNA, 19 bp, Artificial Sequence
  Description of Artificial Sequence: Chemically synthesized oligonucleotide
gctcgcgctctccttcccc

SEQ ID NO: 2569 - DNA, 19 bp, Artificial Sequence
  Description of Artificial Sequence: Chemically synthesized oligonucleotide
gggaaggagagcgcgagcg

SEQ ID NO: 2570 - DNA, 19 bp, Artificial Sequence
  Description of Artificial Sequence: Chemically synthesized oligonucleotide
cgctcgcgctctccttccc

SEQ ID NO: 2571 - DNA, 19 bp, Artificial Sequence
  Description of Artificial Sequence: Chemically synthesized oligonucleotide
ggaaggagagcgcgagcgc

SEQ ID NO: 2572 - DNA, 19 bp, Artificial Sequence
  Description of Artificial Sequence: Chemically synthesized oligonucleotide
gcgctcgcgctctccttcc

SEQ ID NO: 2573 - DNA, 19 bp, Artificial Sequence
  Description of Artificial Sequence: Chemically synthesized oligonucleotide
gaaggagagcgcgagcgcg

SEQ ID NO: 2574 - DNA, 19 bp, Artificial Sequence
  Description of Artificial Sequence: Chemically synthesized oligonucleotide
cgcgctcgcgctctccttc

SEQ ID NO: 2575 - DNA, 19 bp, Artificial Sequence
  Description of Artificial Sequence: Chemically synthesized oligonucleotide
aaggagagcgcgagcgcgc

SEQ ID NO: 2576 - DNA, 19 bp, Artificial Sequence
  Description of Artificial Sequence: Chemically synthesized oligonucleotide
gcgcgctcgcgctctcctt

SEQ ID NO: 2577 - DNA, 19 bp, Artificial Sequence
  Description of Artificial Sequence: Chemically synthesized oligonucleotide
aggagagcgcgagcgcgct

SEQ ID NO: 2578 - DNA, 19 bp, Artificial Sequence
  Description of Artificial Sequence: Chemically synthesized oligonucleotide
agcgcgctcgcgctctcct

SEQ ID NO: 2579 - DNA, 19 bp, Artificial Sequence
  Description of Artificial Sequence: Chemically synthesized oligonucleotide
ggagagcgcgagcgcgctg

SEQ ID NO: 2580 - DNA, 19 bp, Artificial Sequence
  Description of Artificial Sequence: Chemically synthesized oligonucleotide
cagcgcgctcgcgctctcc

SEQ ID NO: 2581 - DNA, 19 bp, Artificial Sequence
  Description of Artificial Sequence: Chemically synthesized oligonucleotide
gagagcgcgagcgcgctga

SEQ ID NO: 2582 - DNA, 19 bp, Artificial Sequence
  Description of Artificial Sequence: Chemically synthesized oligonucleotide
tcagcgcgctcgcgctctc

SEQ ID NO: 2583 - DNA, 19 bp, Artificial Sequence
  Description of Artificial Sequence: Chemically synthesized oligonucleotide
agagcgcgagcgcgctgag

SEQ ID NO: 2584 - DNA, 19 bp, Artificial Sequence
  Description of Artificial Sequence: Chemically synthesized oligonucleotide
ctcagcgcgctcgcgctct

SEQ ID NO: 2585 - DNA, 19 bp, Artificial Sequence
  Description of Artificial Sequence: Chemically synthesized oligonucleotide
gagcgcgagcgcgctgagc

SEQ ID NO: 2586 - DNA, 19 bp, Artificial Sequence
  Description of Artificial Sequence: Chemically synthesized oligonucleotide
gctcagcgcgctcgcgctc

SEQ ID NO: 2587 - DNA, 19 bp, Artificial Sequence
  Description of Artificial Sequence: Chemically synthesized oligonucleotide
agcgcgagcgcgctgagca

SEQ ID NO: 2588 - DNA, 19 bp, Artificial Sequence
  Description of Artificial Sequence: Chemically synthesized oligonucleotide
tgctcagcgcgctcgcgct

SEQ ID NO: 2589 - DNA, 19 bp, Artificial Sequence
  Description of Artificial Sequence: Chemically synthesized oligonucleotide
gcgcgagcgcgctgagcag

SEQ ID NO: 2590 - DNA, 19 bp, Artificial Sequence
  Description of Artificial Sequence: Chemically synthesized oligonucleotide
ctgctcagcgcgctcgcgc

SEQ ID NO: 2591 - DNA, 19 bp, Artificial Sequence
  Description of Artificial Sequence: Chemically synthesized oligonucleotide
cgcgagcgcgctgagcaga

SEQ ID NO: 2592 - DNA, 19 bp, Artificial Sequence
  Description of Artificial Sequence: Chemically synthesized oligonucleotide
tctgctcagcgcgctcgcg

SEQ ID NO: 2593 - DNA, 19 bp, Artificial Sequence
  Description of Artificial Sequence: Chemically synthesized oligonucleotide
gcgagcgcgctgagcagac

SEQ ID NO: 2594 - DNA, 19 bp, Artificial Sequence
  Description of Artificial Sequence: Chemically synthesized oligonucleotide
gtctgctcagcgcgctcgc

SEQ ID NO: 2595 - DNA, 19 bp, Artificial Sequence
  Description of Artificial Sequence: Chemically synthesized oligonucleotide
cgagcgcgctgagcagaca

SEQ ID NO: 2596 - DNA, 19 bp, Artificial Sequence
  Description of Artificial Sequence: Chemically synthesized oligonucleotide
tgtctgctcagcgcgctcg

SEQ ID NO: 2597 - DNA, 19 bp, Artificial Sequence
  Description of Artificial Sequence: Chemically synthesized oligonucleotide
gagcgcgctgagcagacag

SEQ ID NO: 2598 - DNA, 19 bp, Artificial Sequence
  Description of Artificial Sequence: Chemically synthesized oligonucleotide
ctgtctgctcagcgcgctc

SEQ ID NO: 2599 - DNA, 19 bp, Artificial Sequence
  Description of Artificial Sequence: Chemically synthesized oligonucleotide
agcgcgctgagcagacaga

SEQ ID NO: 2600 - DNA, 19 bp, Artificial Sequence
  Description of Artificial Sequence: Chemically synthesized oligonucleotide
tctgtctgctcagcgcgct

SEQ ID NO: 2601 - DNA, 19 bp, Artificial Sequence
  Description of Artificial Sequence: Chemically synthesized oligonucleotide
gcgcgctgagcagacagag

SEQ ID NO: 2602 - DNA, 19 bp, Artificial Sequence
  Description of Artificial Sequence: Chemically synthesized oligonucleotide
ctctgtctgctcagcgcgc

SEQ ID NO: 2603 - DNA, 19 bp, Artificial Sequence
  Description of Artificial Sequence: Chemically synthesized oligonucleotide
cgcgctgagcagacagagc

SEQ ID NO: 2604 - DNA, 19 bp, Artificial Sequence
  Description of Artificial Sequence: Chemically synthesized oligonucleotide
gctctgtctgctcagcgcg

SEQ ID NO: 2605 - DNA, 19 bp, Artificial Sequence
  Description of Artificial Sequence: Chemically synthesized oligonucleotide
gcgctgagcagacagagcg

SEQ ID NO: 2606 - DNA, 19 bp, Artificial Sequence
  Description of Artificial Sequence: Chemically synthesized oligonucleotide
cgctctgtctgctcagcgc

SEQ ID NO: 2607 - DNA, 19 bp, Artificial Sequence
  Description of Artificial Sequence: Chemically synthesized oligonucleotide
cgctgagcagacagagcgg

SEQ ID NO: 2608 - DNA, 19 bp, Artificial Sequence
  Description of Artificial Sequence: Chemically synthesized oligonucleotide
ccgctctgtctgctcagcg

SEQ ID NO: 2609 - DNA, 19 bp, Artificial Sequence
  Description of Artificial Sequence: Chemically synthesized oligonucleotide
gctgagcagacagagcggg

SEQ ID NO: 2610 - DNA, 19 bp, Artificial Sequence
  Description of Artificial Sequence: Chemically synthesized oligonucleotide
cccgctctgtctgctcagc

SEQ ID NO: 2611 - DNA, 19 bp, Artificial Sequence
  Description of Artificial Sequence: Chemically synthesized oligonucleotide
ctgagcagacagagcggga

SEQ ID NO: 2612 - DNA, 19 bp, Artificial Sequence
  Description of Artificial Sequence: Chemically synthesized oligonucleotide
tcccgctctgtctgctcag

SEQ ID NO: 2613 - DNA, 19 bp, Artificial Sequence
  Description of Artificial Sequence: Chemically synthesized oligonucleotide
tgagcagacagagcgggag

SEQ ID NO: 2614 - DNA, 19 bp, Artificial Sequence
  Description of Artificial Sequence: Chemically synthesized oligonucleotide
ctcccgctctgtctgctca

SEQ ID NO: 2615 - DNA, 19 bp, Artificial Sequence
  Description of Artificial Sequence: Chemically synthesized oligonucleotide
gagcagacagagcgggaga

SEQ ID NO: 2616 - DNA, 19 bp, Artificial Sequence
  Description of Artificial Sequence: Chemically synthesized oligonucleotide
tctcccgctctgtctgctc

SEQ ID NO: 2617 - DNA, 19 bp, Artificial Sequence
  Description of Artificial Sequence: Chemically synthesized oligonucleotide
agcagacagagcgggagaa

SEQ ID NO: 2618 - DNA, 19 bp, Artificial Sequence
  Description of Artificial Sequence: Chemically synthesized oligonucleotide
ttctcccgctctgtctgct

SEQ ID NO: 2619 - DNA, 19 bp, Artificial Sequence
  Description of Artificial Sequence: Chemically synthesized oligonucleotide
gcagacagagcgggagaac

SEQ ID NO: 2620 - DNA, 19 bp, Artificial Sequence
  Description of Artificial Sequence: Chemically synthesized oligonucleotide
gttctcccgctctgtctgc

SEQ ID NO: 2621 - DNA, 19 bp, Artificial Sequence
  Description of Artificial Sequence: Chemically synthesized oligonucleotide
cagacagagcgggagaacg

SEQ ID NO: 2622 - DNA, 19 bp, Artificial Sequence
  Description of Artificial Sequence: Chemically synthesized oligonucleotide
cgttctcccgctctgtctg

SEQ ID NO: 2623 - DNA, 19 bp, Artificial Sequence
  Description of Artificial Sequence: Chemically synthesized oligonucleotide
agacagagcgggagaacgc

SEQ ID NO: 2624 - DNA, 19 bp, Artificial Sequence
  Description of Artificial Sequence: Chemically synthesized oligonucleotide
gcgttctcccgctctgtct

SEQ ID NO: 2625 - DNA, 19 bp, Artificial Sequence
  Description of Artificial Sequence: Chemically synthesized oligonucleotide
gacagagcgggagaacgcg

SEQ ID NO: 2626 - DNA, 19 bp, Artificial Sequence
  Description of Artificial Sequence: Chemically synthesized oligonucleotide
cgcgttctcccgctctgtc

SEQ ID NO: 2627 - DNA, 19 bp, Artificial Sequence
  Description of Artificial Sequence: Chemically synthesized oligonucleotide
acagagcgggagaacgcgt

SEQ ID NO: 2628 - DNA, 19 bp, Artificial Sequence
  Description of Artificial Sequence: Chemically synthesized oligonucleotide
acgcgttctcccgctctgt

SEQ ID NO: 2629 - DNA, 19 bp, Artificial Sequence
  Description of Artificial Sequence: Chemically synthesized oligonucleotide
cagagcgggagaacgcgtc

SEQ ID NO: 2630 - DNA, 19 bp, Artificial Sequence
  Description of Artificial Sequence: Chemically synthesized oligonucleotide
gacgcgttctcccgctctg

SEQ ID NO: 2631 - DNA, 19 bp, Artificial Sequence
  Description of Artificial Sequence: Chemically synthesized oligonucleotide
agagcgggagaacgcgtcc

SEQ ID NO: 2632 - DNA, 19 bp, Artificial Sequence
  Description of Artificial Sequence: Chemically synthesized oligonucleotide
ggacgcgttctcccgctct

SEQ ID NO: 2633 - DNA, 19 bp, Artificial Sequence
  Description of Artificial Sequence: Chemically synthesized oligonucleotide
gagcgggagaacgcgtcct

SEQ ID NO: 2634 - DNA, 19 bp, Artificial Sequence
  Description of Artificial Sequence: Chemically synthesized oligonucleotide
aggacgcgttctcccgctc

SEQ ID NO: 2635 - DNA, 19 bp, Artificial Sequence
  Description of Artificial Sequence: Chemically synthesized oligonucleotide
agcgggagaacgcgtcctc

SEQ ID NO: 2636 - DNA, 19 bp, Artificial Sequence
  Description of Artificial Sequence: Chemically synthesized oligonucleotide
gaggacgcgttctcccgct

SEQ ID NO: 2637 - DNA, 19 bp, Artificial Sequence
  Description of Artificial Sequence: Chemically synthesized oligonucleotide
gcgggagaacgcgtcctcg

SEQ ID NO: 2638 - DNA, 19 bp, Artificial Sequence
  Description of Artificial Sequence: Chemically synthesized oligonucleotide
cgaggacgcgttctcccgc

SEQ ID NO: 2639 - DNA, 19 bp, Artificial Sequence
  Description of Artificial Sequence: Chemically synthesized oligonucleotide
cgggagaacgcgtcctcgc

SEQ ID NO: 2640 - DNA, 19 bp, Artificial Sequence
  Description of Artificial Sequence: Chemically synthesized oligonucleotide
gcgaggacgcgttctcccg

SEQ ID NO: 2641 - DNA, 19 bp, Artificial Sequence
  Description of Artificial Sequence: Chemically synthesized oligonucleotide
gggagaacgcgtcctcgcc

SEQ ID NO: 2642 - DNA, 19 bp, Artificial Sequence
  Description of Artificial Sequence: Chemically synthesized oligonucleotide
ggcgaggacgcgttctccc

SEQ ID NO: 2643 - DNA, 19 bp, Artificial Sequence
  Description of Artificial Sequence: Chemically synthesized oligonucleotide
ggagaacgcgtcctcgccc

SEQ ID NO: 2644 - DNA, 19 bp, Artificial Sequence
  Description of Artificial Sequence: Chemically synthesized oligonucleotide
gggcgaggacgcgttctcc

SEQ ID NO: 2645 - DNA, 19 bp, Artificial Sequence
  Description of Artificial Sequence: Chemically synthesized oligonucleotide
gagaacgcgtcctcgcccg

SEQ ID NO: 2646 - DNA, 19 bp, Artificial Sequence
  Description of Artificial Sequence: Chemically synthesized oligonucleotide
cgggcgaggacgcgttctc

SEQ ID NO: 2647 - DNA, 19 bp, Artificial Sequence
  Description of Artificial Sequence: Chemically synthesized oligonucleotide
agaacgcgtcctcgcccgc

SEQ ID NO: 2648 - DNA, 19 bp, Artificial Sequence
  Description of Artificial Sequence: Chemically synthesized oligonucleotide
gcgggcgaggacgcgttct

SEQ ID NO: 2649 - DNA, 19 bp, Artificial Sequence
  Description of Artificial Sequence: Chemically synthesized oligonucleotide
gaacgcgtcctcgcccgcc

SEQ ID NO: 2650 - DNA, 19 bp, Artificial Sequence
  Description of Artificial Sequence: Chemically synthesized oligonucleotide
ggcgggcgaggacgcgttc

SEQ ID NO: 2651 - DNA, 19 bp, Artificial Sequence
  Description of Artificial Sequence: Chemically synthesized oligonucleotide
aacgcgtcctcgcccgccg

SEQ ID NO: 2652 - DNA, 19 bp, Artificial Sequence
  Description of Artificial Sequence: Chemically synthesized oligonucleotide
cggcgggcgaggacgcgtt

SEQ ID NO: 2653 - DNA, 19 bp, Artificial Sequence
  Description of Artificial Sequence: Chemically synthesized oligonucleotide
acgcgtcctcgcccgccgg

SEQ ID NO: 2654 - DNA, 19 bp, Artificial Sequence
  Description of Artificial Sequence: Chemically synthesized oligonucleotide
ccggcgggcgaggacgcgt

SEQ ID NO: 2655 - DNA, 19 bp, Artificial Sequence
  Description of Artificial Sequence: Chemically synthesized oligonucleotide
cgcgtcctcgcccgccggc

SEQ ID NO: 2656 - DNA, 19 bp, Artificial Sequence
  Description of Artificial Sequence: Chemically synthesized oligonucleotide
gccggcgggcgaggacgcg

SEQ ID NO: 2657 - DNA, 19 bp, Artificial Sequence
  Description of Artificial Sequence: Chemically synthesized oligonucleotide
gcgtcctcgcccgccggcc

SEQ ID NO: 2658 - DNA, 19 bp, Artificial Sequence
  Description of Artificial Sequence: Chemically synthesized oligonucleotide
ggccggcgggcgaggacgc

SEQ ID NO: 2659 - DNA, 19 bp, Artificial Sequence
  Description of Artificial Sequence: Chemically synthesized oligonucleotide
cgtcctcgcccgccggccg

SEQ ID NO: 2660 - DNA, 19 bp, Artificial Sequence
  Description of Artificial Sequence: Chemically synthesized oligonucleotide
cggccggcgggcgaggacg

SEQ ID NO: 2661 - DNA, 19 bp, Artificial Sequence
  Description of Artificial Sequence: Chemically synthesized oligonucleotide
gtcctcgcccgccggccgg

SEQ ID NO: 2662 - DNA, 19 bp, Artificial Sequence
  Description of Artificial Sequence: Chemically synthesized oligonucleotide
ccggccggcgggcgaggac

SEQ ID NO: 2663 - DNA, 19 bp, Artificial Sequence
  Description of Artificial Sequence: Chemically synthesized oligonucleotide
tcctcgcccgccggccggg

SEQ ID NO: 2664 - DNA, 19 bp, Artificial Sequence
  Description of Artificial Sequence: Chemically synthesized oligonucleotide
cccggccggcgggcgagga

SEQ ID NO: 2665 - DNA, 19 bp, Artificial Sequence
  Description of Artificial Sequence: Chemically synthesized oligonucleotide
cctcgcccgccggccggga

SEQ ID NO: 2666 - DNA, 19 bp, Artificial Sequence
  Description of Artificial Sequence: Chemically synthesized oligonucleotide
tcccggccggcgggcgagg

SEQ ID NO: 2667 - DNA, 19 bp, Artificial Sequence
  Description of Artificial Sequence: Chemically synthesized oligonucleotide
ctcgcccgccggccgggag

SEQ ID NO: 2668 - DNA, 19 bp, Artificial Sequence
  Description of Artificial Sequence: Chemically synthesized oligonucleotide
ctcccggccggcgggcgag

SEQ ID NO: 2669 - DNA, 19 bp, Artificial Sequence
  Description of Artificial Sequence: Chemically synthesized oligonucleotide
tcgcccgccggccgggagg

SEQ ID NO: 2670 - DNA, 19 bp, Artificial Sequence
  Description of Artificial Sequence: Chemically synthesized oligonucleotide
cctcccggccggcgggcga

SEQ ID NO: 2671 - DNA, 19 bp, Artificial Sequence
  Description of Artificial Sequence: Chemically synthesized oligonucleotide
cgcccgccggccgggaggc

SEQ ID NO: 2672 - DNA, 19 bp, Artificial Sequence
  Description of Artificial Sequence: Chemically synthesized oligonucleotide
gcctcccggccggcgggcg

SEQ ID NO: 2673 - DNA, 19 bp, Artificial Sequence
  Description of Artificial Sequence: Chemically synthesized oligonucleotide
gcccgccggccgggaggcc

SEQ ID NO: 2674 - DNA, 19 bp, Artificial Sequence
  Description of Artificial Sequence: Chemically synthesized oligonucleotide
ggcctcccggccggcgggc

SEQ ID NO: 2675 - DNA, 19 bp, Artificial Sequence
  Description of Artificial Sequence: Chemically synthesized oligonucleotide
cccgccggccgggaggccc

SEQ ID NO: 2676 - DNA, 19 bp, Artificial Sequence
  Description of Artificial Sequence: Chemically synthesized oligonucleotide
gggcctcccggccggcggg

SEQ ID NO: 2677 - DNA, 19 bp, Artificial Sequence
  Description of Artificial Sequence: Chemically synthesized oligonucleotide
ccgccggccgggaggcccc

SEQ ID NO: 2678 - DNA, 19 bp, Artificial Sequence
  Description of Artificial Sequence: Chemically synthesized oligonucleotide
ggggcctcccggccggcgg

SEQ ID NO: 2679 - DNA, 19 bp, Artificial Sequence
  Description of Artificial Sequence: Chemically synthesized oligonucleotide
cgccggccgggaggccccg

SEQ ID NO: 2680 - DNA, 19 bp, Artificial Sequence
  Description of Artificial Sequence: Chemically synthesized oligonucleotide
cggggcctcccggccggcg

SEQ ID NO: 2681 - DNA, 19 bp, Artificial Sequence
  Description of Artificial Sequence: Chemically synthesized oligonucleotide
gccggccgggaggccccgg

SEQ ID NO: 2682 - DNA, 19 bp, Artificial Sequence
  Description of Artificial Sequence: Chemically synthesized oligonucleotide
ccggggcctcccggccggc

SEQ ID NO: 2683 - DNA, 19 bp, Artificial Sequence
  Description of Artificial Sequence: Chemically synthesized oligonucleotide
ccggccgggaggccccgga

SEQ ID NO: 2684 - DNA, 19 bp, Artificial Sequence
  Description of Artificial Sequence: Chemically synthesized oligonucleotide
tccggggcctcccggccgg

SEQ ID NO: 2685 - DNA, 19 bp, Artificial Sequence
  Description of Artificial Sequence: Chemically synthesized oligonucleotide
cggccgggaggccccggag

SEQ ID NO: 2686 - DNA, 19 bp, Artificial Sequence
  Description of Artificial Sequence: Chemically synthesized oligonucleotide
ctccggggcctcccggccg

SEQ ID NO: 2687 - DNA, 19 bp, Artificial Sequence
  Description of Artificial Sequence: Chemically synthesized oligonucleotide
ggccgggaggccccggagc

SEQ ID NO: 2688 - DNA, 19 bp, Artificial Sequence
  Description of Artificial Sequence: Chemically synthesized oligonucleotide
gctccggggcctcccggcc

SEQ ID NO: 2689 - DNA, 19 bp, Artificial Sequence
  Description of Artificial Sequence: Chemically synthesized oligonucleotide
gccgggaggccccggagct

SEQ ID NO: 2690 - DNA, 19 bp, Artificial Sequence
  Description of Artificial Sequence: Chemically synthesized oligonucleotide
agctccggggcctcccggc

SEQ ID NO: 2691 - DNA, 19 bp, Artificial Sequence
  Description of Artificial Sequence: Chemically synthesized oligonucleotide
ccgggaggccccggagctg

SEQ ID NO: 2692 - DNA, 19 bp, Artificial Sequence
  Description of Artificial Sequence: Chemically synthesized oligonucleotide
cagctccggggcctcccgg

SEQ ID NO: 2693 - DNA, 19 bp, Artificial Sequence
  Description of Artificial Sequence: Chemically synthesized oligonucleotide
cgggaggccccggagctgg

SEQ ID NO: 2694 - DNA, 19 bp, Artificial Sequence
  Description of Artificial Sequence: Chemically synthesized oligonucleotide
ccagctccggggcctcccg

SEQ ID NO: 2695 - DNA, 19 bp, Artificial Sequence
  Description of Artificial Sequence: Chemically synthesized oligonucleotide
gggaggccccggagctggc

SEQ ID NO: 2696 - DNA, 19 bp, Artificial Sequence
  Description of Artificial Sequence: Chemically synthesized oligonucleotide
gccagctccggggcctccc

SEQ ID NO: 2697 - DNA, 19 bp, Artificial Sequence
  Description of Artificial Sequence: Chemically synthesized oligonucleotide
ggaggccccggagctggcc

SEQ ID NO: 2698 - DNA, 19 bp, Artificial Sequence
  Description of Artificial Sequence: Chemically synthesized oligonucleotide
ggccagctccggggcctcc

SEQ ID NO: 2699 - DNA, 19 bp, Artificial Sequence
  Description of Artificial Sequence: Chemically synthesized oligonucleotide
gaggccccggagctggccc

SEQ ID NO: 2700 - DNA, 19 bp, Artificial Sequence
  Description of Artificial Sequence: Chemically synthesized oligonucleotide
gggccagctccggggcctc

SEQ ID NO: 2701 - DNA, 19 bp, Artificial Sequence
  Description of Artificial Sequence: Chemically synthesized oligonucleotide
aggccccggagctggccca

SEQ ID NO: 2702 - DNA, 19 bp, Artificial Sequence
  Description of Artificial Sequence: Chemically synthesized oligonucleotide
tgggccagctccggggcct

SEQ ID NO: 2703 - DNA, 19 bp, Artificial Sequence
  Description of Artificial Sequence: Chemically synthesized oligonucleotide
ggccccggagctggcccat

SEQ ID NO: 2704 - DNA, 19 bp, Artificial Sequence
  Description of Artificial Sequence: Chemically synthesized oligonucleotide
atgggccagctccggggcc

SEQ ID NO: 2705 - DNA, 19 bp, Artificial Sequence
  Description of Artificial Sequence: Chemically synthesized oligonucleotide
gccccggagctggcccatg

SEQ ID NO: 2706 - DNA, 19 bp, Artificial Sequence
  Description of Artificial Sequence: Chemically synthesized oligonucleotide
catgggccagctccggggc

SEQ ID NO: 2707 - DNA, 19 bp, Artificial Sequence
  Description of Artificial Sequence: Chemically synthesized oligonucleotide
ccccggagctggcccatgg

SEQ ID NO: 2708 - DNA, 19 bp, Artificial Sequence
  Description of Artificial Sequence: Chemically synthesized oligonucleotide
ccatgggccagctccgggg

SEQ ID NO: 2709 - DNA, 19 bp, Artificial Sequence
  Description of Artificial Sequence: Chemically synthesized oligonucleotide
cccggagctggcccatggg

SEQ ID NO: 2710 - DNA, 19 bp, Artificial Sequence
  Description of Artificial Sequence: Chemically synthesized oligonucleotide
cccatgggccagctccggg

SEQ ID NO: 2711 - DNA, 19 bp, Artificial Sequence
  Description of Artificial Sequence: Chemically synthesized oligonucleotide
ccggagctggcccatgggg

SEQ ID NO: 2712 - DNA, 19 bp, Artificial Sequence
  Description of Artificial Sequence: Chemically synthesized oligonucleotide
ccccatgggccagctccgg

SEQ ID NO: 2713 - DNA, 19 bp, Artificial Sequence
  Description of Artificial Sequence: Chemically synthesized oligonucleotide
cggagctggcccatgggga

SEQ ID NO: 2714 - DNA, 19 bp, Artificial Sequence
  Description of Artificial Sequence: Chemically synthesized oligonucleotide
tccccatgggccagctccg

SEQ ID NO: 2715 - DNA, 19 bp, Artificial Sequence
  Description of Artificial Sequence: Chemically synthesized oligonucleotide
ggagctggcccatggggag

SEQ ID NO: 2716 - DNA, 19 bp, Artificial Sequence
  Description of Artificial Sequence: Chemically synthesized oligonucleotide
ctccccatgggccagctcc

SEQ ID NO: 2717 - DNA, 19 bp, Artificial Sequence
  Description of Artificial Sequence: Chemically synthesized oligonucleotide
gagctggcccatggggagc

SEQ ID NO: 2718 - DNA, 19 bp, Artificial Sequence
  Description of Artificial Sequence: Chemically synthesized oligonucleotide
gctccccatgggccagctc

SEQ ID NO: 2719 - DNA, 19 bp, Artificial Sequence
  Description of Artificial Sequence: Chemically synthesized oligonucleotide
agctggcccatggggagca

SEQ ID NO: 2720 - DNA, 19 bp, Artificial Sequence
  Description of Artificial Sequence: Chemically synthesized oligonucleotide
tgctccccatgggccagct

SEQ ID NO: 2721 - DNA, 19 bp, Artificial Sequence
  Description of Artificial Sequence: Chemically synthesized oligonucleotide
gctggcccatggggagcag

SEQ ID NO: 2722 - DNA, 19 bp, Artificial Sequence
  Description of Artificial Sequence: Chemically synthesized oligonucleotide
ctgctccccatgggccagc

SEQ ID NO: 2723 - DNA, 19 bp, Artificial Sequence
  Description of Artificial Sequence: Chemically synthesized oligonucleotide
ctggcccatggggagcagg

SEQ ID NO: 2724 - DNA, 19 bp, Artificial Sequence
  Description of Artificial Sequence: Chemically synthesized oligonucleotide
cctgctccccatgggccag

SEQ ID NO: 2725 - DNA, 19 bp, Artificial Sequence
  Description of Artificial Sequence: Chemically synthesized oligonucleotide
tggcccatggggagcaggc

SEQ ID NO: 2726 - DNA, 19 bp, Artificial Sequence
  Description of Artificial Sequence: Chemically synthesized oligonucleotide
gcctgctccccatgggcca

SEQ ID NO: 2727 - DNA, 19 bp, Artificial Sequence
  Description of Artificial Sequence: Chemically synthesized oligonucleotide
ggcccatggggagcaggcg

SEQ ID NO: 2728 - DNA, 19 bp, Artificial Sequence
  Description of Artificial Sequence: Chemically synthesized oligonucleotide
cgcctgctccccatgggcc

SEQ ID NO: 2729 - DNA, 19 bp, Artificial Sequence
  Description of Artificial Sequence: Chemically synthesized oligonucleotide
gcccatggggagcaggcgc

SEQ ID NO: 2730 - DNA, 19 bp, Artificial Sequence
  Description of Artificial Sequence: Chemically synthesized oligonucleotide
gcgcctgctccccatgggc

SEQ ID NO: 2731 - DNA, 19 bp, Artificial Sequence
  Description of Artificial Sequence: Chemically synthesized oligonucleotide
cccatggggagcaggcgcc

SEQ ID NO: 2732 - DNA, 19 bp, Artificial Sequence
  Description of Artificial Sequence: Chemically synthesized oligonucleotide
ggcgcctgctccccatggg

SEQ ID NO: 2733 - DNA, 19 bp, Artificial Sequence
  Description of Artificial Sequence: Chemically synthesized oligonucleotide
ccatggggagcaggcgccc

SEQ ID NO: 2734 - DNA, 19 bp, Artificial Sequence
  Description of Artificial Sequence: Chemically synthesized oligonucleotide
gggcgcctgctccccatgg

SEQ ID NO: 2735 - DNA, 19 bp, Artificial Sequence
  Description of Artificial Sequence: Chemically synthesized oligonucleotide
catggggagcaggcgcccg

SEQ ID NO: 2736 - DNA, 19 bp, Artificial Sequence
  Description of Artificial Sequence: Chemically synthesized oligonucleotide
cgggcgcctgctccccatg

SEQ ID NO: 2737 - DNA, 19 bp, Artificial Sequence
  Description of Artificial Sequence: Chemically synthesized oligonucleotide
atggggagcaggcgcccgg

SEQ ID NO: 2738 - DNA, 19 bp, Artificial Sequence
  Description of Artificial Sequence: Chemically synthesized oligonucleotide
ccgggcgcctgctccccat

SEQ ID NO: 2739 - DNA, 19 bp, Artificial Sequence
  Description of Artificial Sequence: Chemically synthesized oligonucleotide
tggggagcaggcgcccggt

SEQ ID NO: 2740 - DNA, 19 bp, Artificial Sequence
  Description of Artificial Sequence: Chemically synthesized oligonucleotide
accgggcgcctgctcccca

SEQ ID NO: 2741 - DNA, 19 bp, Artificial Sequence
  Description of Artificial Sequence: Chemically synthesized oligonucleotide
ggggagcaggcgcccggtg

SEQ ID NO: 2742 - DNA, 19 bp, Artificial Sequence
  Description of Artificial Sequence: Chemically synthesized oligonucleotide
caccgggcgcctgctcccc

SEQ ID NO: 2743 - DNA, 19 bp, Artificial Sequence
  Description of Artificial Sequence: Chemically synthesized oligonucleotide
gggagcaggcgcccggtgc

SEQ ID NO: 2744 - DNA, 19 bp, Artificial Sequence
  Description of Artificial Sequence: Chemically synthesized oligonucleotide
gcaccgggcgcctgctccc

SEQ ID NO: 2745 - DNA, 19 bp, Artificial Sequence
  Description of Artificial Sequence: Chemically synthesized oligonucleotide
ggagcaggcgcccggtgcc

SEQ ID NO: 2746 - DNA, 19 bp, Artificial Sequence
  Description of Artificial Sequence: Chemically synthesized oligonucleotide
ggcaccgggcgcctgctcc

SEQ ID NO: 2747 - DNA, 19 bp, Artificial Sequence
  Description of Artificial Sequence: Chemically synthesized oligonucleotide
gagcaggcgcccggtgccg

SEQ ID NO: 2748 - DNA, 19 bp, Artificial Sequence
  Description of Artificial Sequence: Chemically synthesized oligonucleotide
cggcaccgggcgcctgctc

SEQ ID NO: 2749 - DNA, 19 bp, Artificial Sequence
  Description of Artificial Sequence: Chemically synthesized oligonucleotide
agcaggcgcccggtgccgg

SEQ ID NO: 2750 - DNA, 19 bp, Artificial Sequence
  Description of Artificial Sequence: Chemically synthesized oligonucleotide
ccggcaccgggcgcctgct

SEQ ID NO: 2751 - DNA, 19 bp, Artificial Sequence
  Description of Artificial Sequence: Chemically synthesized oligonucleotide
gcaggcgcccggtgccggc

SEQ ID NO: 2752 - DNA, 19 bp, Artificial Sequence
  Description of Artificial Sequence: Chemically synthesized oligonucleotide
gccggcaccgggcgcctgc

SEQ ID NO: 2753 - DNA, 19 bp, Artificial Sequence
  Description of Artificial Sequence: Chemically synthesized oligonucleotide
caggcgcccggtgccggcc

SEQ ID NO: 2754 - DNA, 19 bp, Artificial Sequence
  Description of Artificial Sequence: Chemically synthesized oligonucleotide
ggccggcaccgggcgcctg

SEQ ID NO: 2755 - DNA, 19 bp, Artificial Sequence
  Description of Artificial Sequence: Chemically synthesized oligonucleotide
aggcgcccggtgccggcca

SEQ ID NO: 2756 - DNA, 19 bp, Artificial Sequence
  Description of Artificial Sequence: Chemically synthesized oligonucleotide
tggccggcaccgggcgcct

SEQ ID NO: 2757 - DNA, 19 bp, Artificial Sequence
  Description of Artificial Sequence: Chemically synthesized oligonucleotide
ggcgcccggtgccggccac

SEQ ID NO: 2758 - DNA, 19 bp, Artificial Sequence
  Description of Artificial Sequence: Chemically synthesized oligonucleotide
gtggccggcaccgggcgcc

SEQ ID NO: 2759 - DNA, 19 bp, Artificial Sequence
  Description of Artificial Sequence: Chemically synthesized oligonucleotide
gcgcccggtgccggccacg

SEQ ID NO: 2760 - DNA, 19 bp, Artificial Sequence
  Description of Artificial Sequence: Chemically synthesized oligonucleotide
cgtggccggcaccgggcgc

SEQ ID NO: 2761 - DNA, 19 bp, Artificial Sequence
  Description of Artificial Sequence: Chemically synthesized oligonucleotide
cgcccggtgccggccacga

SEQ ID NO: 2762 - DNA, 19 bp, Artificial Sequence
  Description of Artificial Sequence: Chemically synthesized oligonucleotide
tcgtggccggcaccgggcg

SEQ ID NO: 2763 - DNA, 19 bp, Artificial Sequence
  Description of Artificial Sequence: Chemically synthesized oligonucleotide
gcccggtgccggccacgac

SEQ ID NO: 2764 - DNA, 19 bp, Artificial Sequence
  Description of Artificial Sequence: Chemically synthesized oligonucleotide
gtcgtggccggcaccgggc

SEQ ID NO: 2765 - DNA, 19 bp, Artificial Sequence
  Description of Artificial Sequence: Chemically synthesized oligonucleotide
cccggtgccggccacgacg

SEQ ID NO: 2766 - DNA, 19 bp, Artificial Sequence
  Description of Artificial Sequence: Chemically synthesized oligonucleotide
cgtcgtggccggcaccggg

SEQ ID NO: 2767 - DNA, 19 bp, Artificial Sequence
  Description of Artificial Sequence: Chemically synthesized oligonucleotide
ccggtgccggccacgacga

SEQ ID NO: 2768 - DNA, 19 bp, Artificial Sequence
  Description of Artificial Sequence: Chemically synthesized oligonucleotide
tcgtcgtggccggcaccgg

SEQ ID NO: 2769 - DNA, 19 bp, Artificial Sequence
  Description of Artificial Sequence: Chemically synthesized oligonucleotide
cggtgccggccacgacgac

SEQ ID NO: 2770 - DNA, 19 bp, Artificial Sequence
  Description of Artificial Sequence: Chemically synthesized oligonucleotide
gtcgtcgtggccggcaccg

SEQ ID NO: 2771 - DNA, 19 bp, Artificial Sequence
  Description of Artificial Sequence: Chemically synthesized oligonucleotide
ggtgccggccacgacgacc

SEQ ID NO: 2772 - DNA, 19 bp, Artificial Sequence
  Description of Artificial Sequence: Chemically synthesized oligonucleotide
ggtcgtcgtggccggcacc

SEQ ID NO: 2773 - DNA, 19 bp, Artificial Sequence
  Description of Artificial Sequence: Chemically synthesized oligonucleotide
gtgccggccacgacgaccg

SEQ ID NO: 2774 - DNA, 19 bp, Artificial Sequence
  Description of Artificial Sequence: Chemically synthesized oligonucleotide
cggtcgtcgtggccggcac

SEQ ID NO: 2775 - DNA, 19 bp, Artificial Sequence
  Description of Artificial Sequence: Chemically synthesized oligonucleotide
tgccggccacgacgaccgc

SEQ ID NO: 2776 - DNA, 19 bp, Artificial Sequence
  Description of Artificial Sequence: Chemically synthesized oligonucleotide
gcggtcgtcgtggccggca

SEQ ID NO: 2777 - DNA, 19 bp, Artificial Sequence
  Description of Artificial Sequence: Chemically synthesized oligonucleotide
gccggccacgacgaccgcc

SEQ ID NO: 2778 - DNA, 19 bp, Artificial Sequence
  Description of Artificial Sequence: Chemically synthesized oligonucleotide
ggcggtcgtcgtggccggc

SEQ ID NO: 2779 - DNA, 19 bp, Artificial Sequence
  Description of Artificial Sequence: Chemically synthesized oligonucleotide
ccggccacgacgaccgcca

SEQ ID NO: 2780 - DNA, 19 bp, Artificial Sequence
  Description of Artificial Sequence: Chemically synthesized oligonucleotide
tggcggtcgtcgtggccgg

SEQ ID NO: 2781 - DNA, 19 bp, Artificial Sequence
  Description of Artificial Sequence: Chemically synthesized oligonucleotide
cggccacgacgaccgccac

SEQ ID NO: 2782 - DNA, 19 bp, Artificial Sequence
  Description of Artificial Sequence: Chemically synthesized oligonucleotide
gtggcggtcgtcgtggccg

SEQ ID NO: 2783 - DNA, 19 bp, Artificial Sequence
  Description of Artificial Sequence: Chemically synthesized oligonucleotide
ggccacgacgaccgccacc

SEQ ID NO: 2784 - DNA, 19 bp, Artificial Sequence
  Description of Artificial Sequence: Chemically synthesized oligonucleotide
ggtggcggtcgtcgtggcc

SEQ ID NO: 2785 - DNA, 19 bp, Artificial Sequence
  Description of Artificial Sequence: Chemically synthesized oligonucleotide
gccacgacgaccgccaccg

SEQ ID NO: 2786 - DNA, 19 bp, Artificial Sequence
  Description of Artificial Sequence: Chemically synthesized oligonucleotide
cggtggcggtcgtcgtggc

SEQ ID NO: 2787 - DNA, 19 bp, Artificial Sequence
  Description of Artificial Sequence: Chemically synthesized oligonucleotide
ccacgacgaccgccaccgc

SEQ ID NO: 2788 - DNA, 19 bp, Artificial Sequence
  Description of Artificial Sequence: Chemically synthesized oligonucleotide
gcggtggcggtcgtcgtgg

SEQ ID NO: 2789 - DNA, 19 bp, Artificial Sequence
  Description of Artificial Sequence: Chemically synthesized oligonucleotide
cacgacgaccgccaccgcc

SEQ ID NO: 2790 - DNA, 19 bp, Artificial Sequence
  Description of Artificial Sequence: Chemically synthesized oligonucleotide
ggcggtggcggtcgtcgtg

SEQ ID NO: 2791 - DNA, 19 bp, Artificial Sequence
  Description of Artificial Sequence: Chemically synthesized oligonucleotide
acgacgaccgccaccgccc

SEQ ID NO: 2792 - DNA, 19 bp, Artificial Sequence
  Description of Artificial Sequence: Chemically synthesized oligonucleotide
gggcggtggcggtcgtcgt

SEQ ID NO: 2793 - DNA, 19 bp, Artificial Sequence
  Description of Artificial Sequence: Chemically synthesized oligonucleotide
cgacgaccgccaccgcccg

SEQ ID NO: 2794 - DNA, 19 bp, Artificial Sequence
  Description of Artificial Sequence: Chemically synthesized oligonucleotide
cgggcggtggcggtcgtcg

SEQ ID NO: 2795 - DNA, 19 bp, Artificial Sequence
  Description of Artificial Sequence: Chemically synthesized oligonucleotide
gacgaccgccaccgcccgc

SEQ ID NO: 2796 - DNA, 19 bp, Artificial Sequence
  Description of Artificial Sequence: Chemically synthesized oligonucleotide
gcgggcggtggcggtcgtc

SEQ ID NO: 2797 - DNA, 19 bp, Artificial Sequence
  Description of Artificial Sequence: Chemically synthesized oligonucleotide
acgaccgccaccgcccgcg

SEQ ID NO: 2798 - DNA, 19 bp, Artificial Sequence
  Description of Artificial Sequence: Chemically synthesized oligonucleotide
cgcgggcggtggcggtcgt

SEQ ID NO: 2799 - DNA, 19 bp, Artificial Sequence
  Description of Artificial Sequence: Chemically synthesized oligonucleotide
cgaccgccaccgcccgcgc

SEQ ID NO: 2800 - DNA, 19 bp, Artificial Sequence
  Description of Artificial Sequence: Chemically synthesized oligonucleotide
gcgcgggcggtggcggtcg

SEQ ID NO: 2801 - DNA, 19 bp, Artificial Sequence
  Description of Artificial Sequence: Chemically synthesized oligonucleotide
gaccgccaccgcccgcgcc

SEQ ID NO: 2802 - DNA, 19 bp, Artificial Sequence
  Description of Artificial Sequence: Chemically synthesized oligonucleotide
ggcgcgggcggtggcggtc

SEQ ID NO: 2803 - DNA, 19 bp, Artificial Sequence
  Description of Artificial Sequence: Chemically synthesized oligonucleotide
accgccaccgcccgcgccg

SEQ ID NO: 2804 - DNA, 19 bp, Artificial Sequence
  Description of Artificial Sequence: Chemically synthesized oligonucleotide
cggcgcgggcggtggcggt

SEQ ID NO: 2805 - DNA, 19 bp, Artificial Sequence
  Description of Artificial Sequence: Chemically synthesized oligonucleotide
ccgccaccgcccgcgccgc

SEQ ID NO: 2806 - DNA, 19 bp, Artificial Sequence
  Description of Artificial Sequence: Chemically synthesized oligonucleotide
gcggcgcgggcggtggcgg

SEQ ID NO: 2807 - DNA, 19 bp, Artificial Sequence
  Description of Artificial Sequence: Chemically synthesized oligonucleotide
cgccaccgcccgcgccgcg

SEQ ID NO: 2808 - DNA, 19 bp, Artificial Sequence
  Description of Artificial Sequence: Chemically synthesized oligonucleotide
cgcggcgcgggcggtggcg

SEQ ID NO: 2809 - DNA, 19 bp, Artificial Sequence
  Description of Artificial Sequence: Chemically synthesized oligonucleotide
gccaccgcccgcgccgcga

SEQ ID NO: 2810 - DNA, 19 bp, Artificial Sequence
  Description of Artificial Sequence: Chemically synthesized oligonucleotide
tcgcggcgcgggcggtggc

SEQ ID NO: 2811 - DNA, 19 bp, Artificial Sequence
  Description of Artificial Sequence: Chemically synthesized oligonucleotide
ccaccgcccgcgccgcgac

SEQ ID NO: 2812 - DNA, 19 bp, Artificial Sequence
  Description of Artificial Sequence: Chemically synthesized oligonucleotide
gtcgcggcgcgggcggtgg

SEQ ID NO: 2813 - DNA, 19 bp, Artificial Sequence
  Description of Artificial Sequence: Chemically synthesized oligonucleotide
caccgcccgcgccgcgacc

SEQ ID NO: 2814 - DNA, 19 bp, Artificial Sequence
  Description of Artificial Sequence: Chemically synthesized oligonucleotide
ggtcgcggcgcgggcggtg

SEQ ID NO: 2815 - DNA, 19 bp, Artificial Sequence
  Description of Artificial Sequence: Chemically synthesized oligonucleotide
accgcccgcgccgcgaccg

SEQ ID NO: 2816 - DNA, 19 bp, Artificial Sequence
  Description of Artificial Sequence: Chemically synthesized oligonucleotide
cggtcgcggcgcgggcggt

SEQ ID NO: 2817 - DNA, 19 bp, Artificial Sequence
  Description of Artificial Sequence: Chemically synthesized oligonucleotide
ccgcccgcgccgcgaccgg

SEQ ID NO: 2818 - DNA, 19 bp, Artificial Sequence
  Description of Artificial Sequence: Chemically synthesized oligonucleotide
ccggtcgcggcgcgggcgg

SEQ ID NO: 2819 - DNA, 19 bp, Artificial Sequence
  Description of Artificial Sequence: Chemically synthesized oligonucleotide
cgcccgcgccgcgaccggc

SEQ ID NO: 2820 - DNA, 19 bp, Artificial Sequence
  Description of Artificial Sequence: Chemically synthesized oligonucleotide
gccggtcgcggcgcgggcg

SEQ ID NO: 2821 - DNA, 19 bp, Artificial Sequence
  Description of Artificial Sequence: Chemically synthesized oligonucleotide
gcccgcgccgcgaccggcc

SEQ ID NO: 2822 - DNA, 19 bp, Artificial Sequence
  Description of Artificial Sequence: Chemically synthesized oligonucleotide
ggccggtcgcggcgcgggc

SEQ ID NO: 2823 - DNA, 19 bp, Artificial Sequence
  Description of Artificial Sequence: Chemically synthesized oligonucleotide
cccgcgccgcgaccggccg

SEQ ID NO: 2824 - DNA, 19 bp, Artificial Sequence
  Description of Artificial Sequence: Chemically synthesized oligonucleotide
cggccggtcgcggcgcggg

SEQ ID NO: 2825 - DNA, 19 bp, Artificial Sequence
  Description of Artificial Sequence: Chemically synthesized oligonucleotide
ccgcgccgcgaccggccgg

SEQ ID NO: 2826 - DNA, 19 bp, Artificial Sequence
  Description of Artificial Sequence: Chemically synthesized oligonucleotide
ccggccggtcgcggcgcgg

SEQ ID NO: 2827 - DNA, 19 bp, Artificial Sequence
  Description of Artificial Sequence: Chemically synthesized oligonucleotide
cgcgccgcgaccggccggt

SEQ ID NO: 2828 - DNA, 19 bp, Artificial Sequence
  Description of Artificial Sequence: Chemically synthesized oligonucleotide
accggccggtcgcggcgcg

SEQ ID NO: 2829 - DNA, 19 bp, Artificial Sequence
  Description of Artificial Sequence: Chemically synthesized oligonucleotide
gcgccgcgaccggccggtg

SEQ ID NO: 2830 - DNA, 19 bp, Artificial Sequence
  Description of Artificial Sequence: Chemically synthesized oligonucleotide
caccggccggtcgcggcgc

SEQ ID NO: 2831 - DNA, 19 bp, Artificial Sequence
  Description of Artificial Sequence: Chemically synthesized oligonucleotide
cgccgcgaccggccggtga

SEQ ID NO: 2832 - DNA, 19 bp, Artificial Sequence
  Description of Artificial Sequence: Chemically synthesized oligonucleotide
tcaccggccggtcgcggcg

SEQ ID NO: 2833 - DNA, 19 bp, Artificial Sequence
  Description of Artificial Sequence: Chemically synthesized oligonucleotide
gccgcgaccggccggtgaa

SEQ ID NO: 2834 - DNA, 19 bp, Artificial Sequence
  Description of Artificial Sequence: Chemically synthesized oligonucleotide
ttcaccggccggtcgcggc

SEQ ID NO: 2835 - DNA, 19 bp, Artificial Sequence
  Description of Artificial Sequence: Chemically synthesized oligonucleotide
ccgcgaccggccggtgaag

SEQ ID NO: 2836 - DNA, 19 bp, Artificial Sequence
  Description of Artificial Sequence: Chemically synthesized oligonucleotide
cttcaccggccggtcgcgg

SEQ ID NO: 2837 - DNA, 19 bp, Artificial Sequence
  Description of Artificial Sequence: Chemically synthesized oligonucleotide
cgcgaccggccggtgaagc

SEQ ID NO: 2838 - DNA, 19 bp, Artificial Sequence
  Description of Artificial Sequence: Chemically synthesized oligonucleotide
gcttcaccggccggtcgcg

SEQ ID NO: 2839 - DNA, 19 bp, Artificial Sequence
  Description of Artificial Sequence: Chemically synthesized oligonucleotide
gcgaccggccggtgaagcc

SEQ ID NO: 2840 - DNA, 19 bp, Artificial Sequence
  Description of Artificial Sequence: Chemically synthesized oligonucleotide
ggcttcaccggccggtcgc

SEQ ID NO: 2841 - DNA, 19 bp, Artificial Sequence
  Description of Artificial Sequence: Chemically synthesized oligonucleotide
cgaccggccggtgaagccc

SEQ ID NO: 2842 - DNA, 19 bp, Artificial Sequence
  Description of Artificial Sequence: Chemically synthesized oligonucleotide
gggcttcaccggccggtcg

SEQ ID NO: 2843 - DNA, 19 bp, Artificial Sequence
  Description of Artificial Sequence: Chemically synthesized oligonucleotide
gaccggccggtgaagccca

SEQ ID NO: 2844 - DNA, 19 bp, Artificial Sequence
  Description of Artificial Sequence: Chemically synthesized oligonucleotide
tgggcttcaccggccggtc

SEQ ID NO: 2845 - DNA, 19 bp, Artificial Sequence
  Description of Artificial Sequence: Chemically synthesized oligonucleotide
accggccggtgaagcccag

SEQ ID NO: 2846 - DNA, 19 bp, Artificial Sequence
  Description of Artificial Sequence: Chemically synthesized oligonucleotide
ctgggcttcaccggccggt

SEQ ID NO: 2847 - DNA, 19 bp, Artificial Sequence
  Description of Artificial Sequence: Chemically synthesized oligonucleotide
ccggccggtgaagcccagg

SEQ ID NO: 2848 - DNA, 19 bp, Artificial Sequence
  Description of Artificial Sequence: Chemically synthesized oligonucleotide
cctgggcttcaccggccgg

SEQ ID NO: 2849 - DNA, 19 bp, Artificial Sequence
  Description of Artificial Sequence: Chemically synthesized oligonucleotide
cggccggtgaagcccaggg

SEQ ID NO: 2850 - DNA, 19 bp, Artificial Sequence
  Description of Artificial Sequence: Chemically synthesized oligonucleotide
ccctgggcttcaccggccg

SEQ ID NO: 2851 - DNA, 19 bp, Artificial Sequence
  Description of Artificial Sequence: Chemically synthesized oligonucleotide
ggccggtgaagcccaggga

SEQ ID NO: 2852 - DNA, 19 bp, Artificial Sequence
  Description of Artificial Sequence: Chemically synthesized oligonucleotide
tccctgggcttcaccggcc

SEQ ID NO: 2853 - DNA, 19 bp, Artificial Sequence
  Description of Artificial Sequence: Chemically synthesized oligonucleotide
gccggtgaagcccagggac

SEQ ID NO: 2854 - DNA, 19 bp, Artificial Sequence
  Description of Artificial Sequence: Chemically synthesized oligonucleotide
gtccctgggcttcaccggc

SEQ ID NO: 2855 - DNA, 19 bp, Artificial Sequence
  Description of Artificial Sequence: Chemically synthesized oligonucleotide
ccggtgaagcccagggacc

SEQ ID NO: 2856 - DNA, 19 bp, Artificial Sequence
  Description of Artificial Sequence: Chemically synthesized oligonucleotide
ggtccctgggcttcaccgg

SEQ ID NO: 2857 - DNA, 19 bp, Artificial Sequence
  Description of Artificial Sequence: Chemically synthesized oligonucleotide
cggtgaagcccagggaccc

SEQ ID NO: 2858 - DNA, 19 bp, Artificial Sequence
  Description of Artificial Sequence: Chemically synthesized oligonucleotide
gggtccctgggcttcaccg

SEQ ID NO: 2859 - DNA, 19 bp, Artificial Sequence
  Description of Artificial Sequence: Chemically synthesized oligonucleotide
ggtgaagcccagggacccc

SEQ ID NO: 2860 - DNA, 19 bp, Artificial Sequence
  Description of Artificial Sequence: Chemically synthesized oligonucleotide
ggggtccctgggcttcacc

SEQ ID NO: 2861 - DNA, 19 bp, Artificial Sequence
  Description of Artificial Sequence: Chemically synthesized oligonucleotide
gtgaagcccagggaccccc

SEQ ID NO: 2862 - DNA, 19 bp, Artificial Sequence
  Description of Artificial Sequence: Chemically synthesized oligonucleotide
gggggtccctgggcttcac

SEQ ID NO: 2863 - DNA, 19 bp, Artificial Sequence
  Description of Artificial Sequence: Chemically synthesized oligonucleotide
tgaagcccagggacccccc

SEQ ID NO: 2864 - DNA, 19 bp, Artificial Sequence
  Description of Artificial Sequence: Chemically synthesized oligonucleotide
ggggggtccctgggcttca

SEQ ID NO: 2865 - DNA, 19 bp, Artificial Sequence
  Description of Artificial Sequence: Chemically synthesized oligonucleotide
gaagcccagggacccccct

SEQ ID NO: 2866 - DNA, 19 bp, Artificial Sequence
  Description of Artificial Sequence: Chemically synthesized oligonucleotide
aggggggtccctgggcttc

SEQ ID NO: 2867 - DNA, 19 bp, Artificial Sequence
  Description of Artificial Sequence: Chemically synthesized oligonucleotide
aagcccagggacccccctc

SEQ ID NO: 2868 - DNA, 19 bp, Artificial Sequence
  Description of Artificial Sequence: Chemically synthesized oligonucleotide
gaggggggtccctgggctt

SEQ ID NO: 2869 - DNA, 19 bp, Artificial Sequence
  Description of Artificial Sequence: Chemically synthesized oligonucleotide
agcccagggacccccctct

SEQ ID NO: 2870 - DNA, 19 bp, Artificial Sequence
  Description of Artificial Sequence: Chemically synthesized oligonucleotide
agaggggggtccctgggct

SEQ ID NO: 2871 - DNA, 19 bp, Artificial Sequence
  Description of Artificial Sequence: Chemically synthesized oligonucleotide
gcccagggacccccctctg

SEQ ID NO: 2872 - DNA, 19 bp, Artificial Sequence
  Description of Artificial Sequence: Chemically synthesized oligonucleotide
cagaggggggtccctgggc

SEQ ID NO: 2873 - DNA, 19 bp, Artificial Sequence
  Description of Artificial Sequence: Chemically synthesized oligonucleotide
cccagggacccccctctgg

SEQ ID NO: 2874 - DNA, 19 bp, Artificial Sequence
  Description of Artificial Sequence: Chemically synthesized oligonucleotide
ccagaggggggtccctggg

SEQ ID NO: 2875 - DNA, 19 bp, Artificial Sequence
  Description of Artificial Sequence: Chemically synthesized oligonucleotide
ccagggacccccctctggg

SEQ ID NO: 2876 - DNA, 19 bp, Artificial Sequence
  Description of Artificial Sequence: Chemically synthesized oligonucleotide
cccagaggggggtccctgg

SEQ ID NO: 2877 - DNA, 19 bp, Artificial Sequence
  Description of Artificial Sequence: Chemically synthesized oligonucleotide
cagggacccccctctggga

SEQ ID NO: 2878 - DNA, 19 bp, Artificial Sequence
  Description of Artificial Sequence: Chemically synthesized oligonucleotide
tcccagaggggggtccctg

SEQ ID NO: 2879 - DNA, 19 bp, Artificial Sequence
  Description of Artificial Sequence: Chemically synthesized oligonucleotide
agggacccccctctgggag

SEQ ID NO: 2880 - DNA, 19 bp, Artificial Sequence
  Description of Artificial Sequence: Chemically synthesized oligonucleotide
ctcccagaggggggtccct

SEQ ID NO: 2881 - DNA, 19 bp, Artificial Sequence
  Description of Artificial Sequence: Chemically synthesized oligonucleotide
gggacccccctctgggaga

SEQ ID NO: 2882 - DNA, 19 bp, Artificial Sequence
  Description of Artificial Sequence: Chemically synthesized oligonucleotide
tctcccagaggggggtccc

SEQ ID NO: 2883 - DNA, 19 bp, Artificial Sequence
  Description of Artificial Sequence: Chemically synthesized oligonucleotide
ggacccccctctgggagag

SEQ ID NO: 2884 - DNA, 19 bp, Artificial Sequence
  Description of Artificial Sequence: Chemically synthesized oligonucleotide
ctctcccagaggggggtcc

SEQ ID NO: 2885 - DNA, 19 bp, Artificial Sequence
  Description of Artificial Sequence: Chemically synthesized oligonucleotide
gacccccctctgggagagc

SEQ ID NO: 2886 - DNA, 19 bp, Artificial Sequence
  Description of Artificial Sequence: Chemically synthesized oligonucleotide
gctctcccagaggggggtc

SEQ ID NO: 2887 - DNA, 19 bp, Artificial Sequence
  Description of Artificial Sequence: Chemically synthesized oligonucleotide
acccccctctgggagagcc

SEQ ID NO: 2888 - DNA, 19 bp, Artificial Sequence
  Description of Artificial Sequence: Chemically synthesized oligonucleotide
ggctctcccagaggggggt

SEQ ID NO: 2889 - DNA, 19 bp, Artificial Sequence
  Description of Artificial Sequence: Chemically synthesized oligonucleotide
cccccctctgggagagccc

SEQ ID NO: 2890 - DNA, 19 bp, Artificial Sequence
  Description of Artificial Sequence: Chemically synthesized oligonucleotide
gggctctcccagagggggg

SEQ ID NO: 2891 - DNA, 19 bp, Artificial Sequence
  Description of Artificial Sequence: Chemically synthesized oligonucleotide
ccccctctgggagagcccc

SEQ ID NO: 2892 - DNA, 19 bp, Artificial Sequence
  Description of Artificial Sequence: Chemically synthesized oligonucleotide
ggggctctcccagaggggg

SEQ ID NO: 2893 - DNA, 19 bp, Artificial Sequence
  Description of Artificial Sequence: Chemically synthesized oligonucleotide
cccctctgggagagcccca

SEQ ID NO: 2894 - DNA, 19 bp, Artificial Sequence
  Description of Artificial Sequence: Chemically synthesized oligonucleotide
tggggctctcccagagggg

SEQ ID NO: 2895 - DNA, 19 bp, Artificial Sequence
  Description of Artificial Sequence: Chemically synthesized oligonucleotide
ccctctgggagagccccat

SEQ ID NO: 2896 - DNA, 19 bp, Artificial Sequence
  Description of Artificial Sequence: Chemically synthesized oligonucleotide
atggggctctcccagaggg

SEQ ID NO: 2897 - DNA, 19 bp, Artificial Sequence
  Description of Artificial Sequence: Chemically synthesized oligonucleotide
cctctgggagagccccatg

SEQ ID NO: 2898 - DNA, 19 bp, Artificial Sequence
  Description of Artificial Sequence: Chemically synthesized oligonucleotide
catggggctctcccagagg

SEQ ID NO: 2899 - DNA, 19 bp, Artificial Sequence
  Description of Artificial Sequence: Chemically synthesized oligonucleotide
ctctgggagagccccatga

SEQ ID NO: 2900 - DNA, 19 bp, Artificial Sequence
  Description of Artificial Sequence: Chemically synthesized oligonucleotide
tcatggggctctcccagag

SEQ ID NO: 2901 - DNA, 19 bp, Artificial Sequence
  Description of Artificial Sequence: Chemically synthesized oligonucleotide
tctgggagagccccatgag

SEQ ID NO: 2902 - DNA, 19 bp, Artificial Sequence
  Description of Artificial Sequence: Chemically synthesized oligonucleotide
ctcatggggctctcccaga

SEQ ID NO: 2903 - DNA, 19 bp, Artificial Sequence
  Description of Artificial Sequence: Chemically synthesized oligonucleotide
ctgggagagccccatgagg

SEQ ID NO: 2904 - DNA, 19 bp, Artificial Sequence
  Description of Artificial Sequence: Chemically synthesized oligonucleotide
cctcatggggctctcccag

SEQ ID NO: 2905 - DNA, 19 bp, Artificial Sequence
  Description of Artificial Sequence: Chemically synthesized oligonucleotide
tgggagagccccatgaggg

SEQ ID NO: 2906 - DNA, 19 bp, Artificial Sequence
  Description of Artificial Sequence: Chemically synthesized oligonucleotide
ccctcatggggctctccca

SEQ ID NO: 2907 - DNA, 19 bp, Artificial Sequence
  Description of Artificial Sequence: Chemically synthesized oligonucleotide
gggagagccccatgagggc

SEQ ID NO: 2908 - DNA, 19 bp, Artificial Sequence
  Description of Artificial Sequence: Chemically synthesized oligonucleotide
gccctcatggggctctccc

SEQ ID NO: 2909 - DNA, 19 bp, Artificial Sequence
  Description of Artificial Sequence: Chemically synthesized oligonucleotide
ggagagccccatgagggca

SEQ ID NO: 2910 - DNA, 19 bp, Artificial Sequence
  Description of Artificial Sequence: Chemically synthesized oligonucleotide
tgccctcatggggctctcc

SEQ ID NO: 2911 - DNA, 19 bp, Artificial Sequence
  Description of Artificial Sequence: Chemically synthesized oligonucleotide
gagagccccatgagggcag

SEQ ID NO: 2912 - DNA, 19 bp, Artificial Sequence
  Description of Artificial Sequence: Chemically synthesized oligonucleotide
ctgccctcatggggctctc

SEQ ID NO: 2913 - DNA, 19 bp, Artificial Sequence
  Description of Artificial Sequence: Chemically synthesized oligonucleotide
agagccccatgagggcagg

SEQ ID NO: 2914 - DNA, 19 bp, Artificial Sequence
  Description of Artificial Sequence: Chemically synthesized oligonucleotide
cctgccctcatggggctct

SEQ ID NO: 2915 - DNA, 19 bp, Artificial Sequence
  Description of Artificial Sequence: Chemically synthesized oligonucleotide
gagccccatgagggcagga

SEQ ID NO: 2916 - DNA, 19 bp, Artificial Sequence
  Description of Artificial Sequence: Chemically synthesized oligonucleotide
tcctgccctcatggggctc

SEQ ID NO: 2917 - DNA, 19 bp, Artificial Sequence
  Description of Artificial Sequence: Chemically synthesized oligonucleotide
agccccatgagggcaggag

SEQ ID NO: 2918 - DNA, 19 bp, Artificial Sequence
  Description of Artificial Sequence: Chemically synthesized oligonucleotide
ctcctgccctcatggggct

SEQ ID NO: 2919 - DNA, 19 bp, Artificial Sequence
  Description of Artificial Sequence: Chemically synthesized oligonucleotide
gccccatgagggcaggaga

SEQ ID NO: 2920 - DNA, 19 bp, Artificial Sequence
  Description of Artificial Sequence: Chemically synthesized oligonucleotide
tctcctgccctcatggggc

SEQ ID NO: 2921 - DNA, 19 bp, Artificial Sequence
  Description of Artificial Sequence: Chemically synthesized oligonucleotide
ccccatgagggcaggagag

SEQ ID NO: 2922 - DNA, 19 bp, Artificial Sequence
  Description of Artificial Sequence: Chemically synthesized oligonucleotide
ctctcctgccctcatgggg

SEQ ID NO: 2923 - DNA, 19 bp, Artificial Sequence
  Description of Artificial Sequence: Chemically synthesized oligonucleotide
cccatgagggcaggagagt

SEQ ID NO: 2924 - DNA, 19 bp, Artificial Sequence
  Description of Artificial Sequence: Chemically synthesized oligonucleotide
actctcctgccctcatggg

SEQ ID NO: 2925 - DNA, 19 bp, Artificial Sequence
  Description of Artificial Sequence: Chemically synthesized oligonucleotide
ccatgagggcaggagagtg

SEQ ID NO: 2926 - DNA, 19 bp, Artificial Sequence
  Description of Artificial Sequence: Chemically synthesized oligonucleotide
cactctcctgccctcatgg

SEQ ID NO: 2927 - DNA, 19 bp, Artificial Sequence
  Description of Artificial Sequence: Chemically synthesized oligonucleotide
catgagggcaggagagtga

SEQ ID NO: 2928 - DNA, 19 bp, Artificial Sequence
  Description of Artificial Sequence: Chemically synthesized oligonucleotide
tcactctcctgccctcatg

SEQ ID NO: 2929 - DNA, 19 bp, Artificial Sequence
  Description of Artificial Sequence: Chemically synthesized oligonucleotide
atgagggcaggagagtgat

SEQ ID NO: 2930 - DNA, 19 bp, Artificial Sequence
  Description of Artificial Sequence: Chemically synthesized oligonucleotide
atcactctcctgccctcat

SEQ ID NO: 2931 - DNA, 19 bp, Artificial Sequence
  Description of Artificial Sequence: Chemically synthesized oligonucleotide
tgagggcaggagagtgatg

SEQ ID NO: 2932 - DNA, 19 bp, Artificial Sequence
  Description of Artificial Sequence: Chemically synthesized oligonucleotide
catcactctcctgccctca

SEQ ID NO: 2933 - DNA, 19 bp, Artificial Sequence
  Description of Artificial Sequence: Chemically synthesized oligonucleotide
gagggcaggagagtgatgg

SEQ ID NO: 2934 - DNA, 19 bp, Artificial Sequence
  Description of Artificial Sequence: Chemically synthesized oligonucleotide
ccatcactctcctgccctc

SEQ ID NO: 2935 - DNA, 19 bp, Artificial Sequence
  Description of Artificial Sequence: Chemically synthesized oligonucleotide
agggcaggagagtgatgga

SEQ ID NO: 2936 - DNA, 19 bp, Artificial Sequence
  Description of Artificial Sequence: Chemically synthesized oligonucleotide
tccatcactctcctgccct

SEQ ID NO: 2937 - DNA, 19 bp, Artificial Sequence
  Description of Artificial Sequence: Chemically synthesized oligonucleotide
gggcaggagagtgatggag

SEQ ID NO: 2938 - DNA, 19 bp, Artificial Sequence
  Description of Artificial Sequence: Chemically synthesized oligonucleotide
ctccatcactctcctgccc

SEQ ID NO: 2939 - DNA, 19 bp, Artificial Sequence
  Description of Artificial Sequence: Chemically synthesized oligonucleotide
ggcaggagagtgatggaga

SEQ ID NO: 2940 - DNA, 19 bp, Artificial Sequence
  Description of Artificial Sequence: Chemically synthesized oligonucleotide
tctccatcactctcctgcc

SEQ ID NO: 2941 - DNA, 19 bp, Artificial Sequence
  Description of Artificial Sequence: Chemically synthesized oligonucleotide
gcaggagagtgatggagag

SEQ ID NO: 2942 - DNA, 19 bp, Artificial Sequence
  Description of Artificial Sequence: Chemically synthesized oligonucleotide
ctctccatcactctcctgc

SEQ ID NO: 2943 - DNA, 19 bp, Artificial Sequence
  Description of Artificial Sequence: Chemically synthesized oligonucleotide
caggagagtgatggagagt

SEQ ID NO: 2944 - DNA, 19 bp, Artificial Sequence
  Description of Artificial Sequence: Chemically synthesized oligonucleotide
actctccatcactctcctg

SEQ ID NO: 2945 - DNA, 19 bp, Artificial Sequence
  Description of Artificial Sequence: Chemically synthesized oligonucleotide
aggagagtgatggagagta

SEQ ID NO: 2946 - DNA, 19 bp, Artificial Sequence
  Description of Artificial Sequence: Chemically synthesized oligonucleotide
tactctccatcactctcct

SEQ ID NO: 2947 - DNA, 19 bp, Artificial Sequence
  Description of Artificial Sequence: Chemically synthesized oligonucleotide
ggagagtgatggagagtac

SEQ ID NO: 2948 - DNA, 19 bp, Artificial Sequence
  Description of Artificial Sequence: Chemically synthesized oligonucleotide
gtactctccatcactctcc

SEQ ID NO: 2949 - DNA, 19 bp, Artificial Sequence
  Description of Artificial Sequence: Chemically synthesized oligonucleotide
gagagtgatggagagtacg

SEQ ID NO: 2950 - DNA, 19 bp, Artificial Sequence
  Description of Artificial Sequence: Chemically synthesized oligonucleotide
cgtactctccatcactctc

SEQ ID NO: 2951 - DNA, 19 bp, Artificial Sequence
  Description of Artificial Sequence: Chemically synthesized oligonucleotide
agagtgatggagagtacgc

SEQ ID NO: 2952 - DNA, 19 bp, Artificial Sequence
  Description of Artificial Sequence: Chemically synthesized oligonucleotide
gcgtactctccatcactct

SEQ ID NO: 2953 - DNA, 19 bp, Artificial Sequence
  Description of Artificial Sequence: Chemically synthesized oligonucleotide
gagtgatggagagtacgcc

SEQ ID NO: 2954 - DNA, 19 bp, Artificial Sequence
  Description of Artificial Sequence: Chemically synthesized oligonucleotide
ggcgtactctccatcactc

SEQ ID NO: 2955 - DNA, 19 bp, Artificial Sequence
  Description of Artificial Sequence: Chemically synthesized oligonucleotide
agtgatggagagtacgccc

SEQ ID NO: 2956 - DNA, 19 bp, Artificial Sequence
  Description of Artificial Sequence: Chemically synthesized oligonucleotide
gggcgtactctccatcact

SEQ ID NO: 2957 - DNA, 19 bp, Artificial Sequence
  Description of Artificial Sequence: Chemically synthesized oligonucleotide
gtgatggagagtacgccca

SEQ ID NO: 2958 - DNA, 19 bp, Artificial Sequence
  Description of Artificial Sequence: Chemically synthesized oligonucleotide
tgggcgtactctccatcac

SEQ ID NO: 2959 - DNA, 19 bp, Artificial Sequence
  Description of Artificial Sequence: Chemically synthesized oligonucleotide
tgatggagagtacgcccag

SEQ ID NO: 2960 - DNA, 19 bp, Artificial Sequence
  Description of Artificial Sequence: Chemically synthesized oligonucleotide
ctgggcgtactctccatca

SEQ ID NO: 2961 - DNA, 19 bp, Artificial Sequence
  Description of Artificial Sequence: Chemically synthesized oligonucleotide
gatggagagtacgcccagc

SEQ ID NO: 2962 - DNA, 19 bp, Artificial Sequence
  Description of Artificial Sequence: Chemically synthesized oligonucleotide
gctgggcgtactctccatc

SEQ ID NO: 2963 - DNA, 19 bp, Artificial Sequence
  Description of Artificial Sequence: Chemically synthesized oligonucleotide
atggagagtacgcccagct

SEQ ID NO: 2964 - DNA, 19 bp, Artificial Sequence
  Description of Artificial Sequence: Chemically synthesized oligonucleotide
agctgggcgtactctccat

SEQ ID NO: 2965 - DNA, 19 bp, Artificial Sequence
  Description of Artificial Sequence: Chemically synthesized oligonucleotide
tggagagtacgcccagctt

SEQ ID NO: 2966 - DNA, 19 bp, Artificial Sequence
  Description of Artificial Sequence: Chemically synthesized oligonucleotide
aagctgggcgtactctcca

SEQ ID NO: 2967 - DNA, 19 bp, Artificial Sequence
  Description of Artificial Sequence: Chemically synthesized oligonucleotide
ggagagtacgcccagcttc

SEQ ID NO: 2968 - DNA, 19 bp, Artificial Sequence
  Description of Artificial Sequence: Chemically synthesized oligonucleotide
gaagctgggcgtactctcc

SEQ ID NO: 2969 - DNA, 19 bp, Artificial Sequence
  Description of Artificial Sequence: Chemically synthesized oligonucleotide
gagagtacgcccagcttcc

SEQ ID NO: 2970 - DNA, 19 bp, Artificial Sequence
  Description of Artificial Sequence: Chemically synthesized oligonucleotide
ggaagctgggcgtactctc

SEQ ID NO: 2971 - DNA, 19 bp, Artificial Sequence
  Description of Artificial Sequence: Chemically synthesized oligonucleotide
agagtacgcccagcttcct

SEQ ID NO: 2972 - DNA, 19 bp, Artificial Sequence
  Description of Artificial Sequence: Chemically synthesized oligonucleotide
aggaagctgggcgtactct

SEQ ID NO: 2973 - DNA, 19 bp, Artificial Sequence
  Description of Artificial Sequence: Chemically synthesized oligonucleotide
gagtacgcccagcttcctg

SEQ ID NO: 2974 - DNA, 19 bp, Artificial Sequence
  Description of Artificial Sequence: Chemically synthesized oligonucleotide
caggaagctgggcgtactc

SEQ ID NO: 2975 - DNA, 19 bp, Artificial Sequence
  Description of Artificial Sequence: Chemically synthesized oligonucleotide
agtacgcccagcttcctga

SEQ ID NO: 2976 - DNA, 19 bp, Artificial Sequence
  Description of Artificial Sequence: Chemically synthesized oligonucleotide
tcaggaagctgggcgtact

SEQ ID NO: 2977 - DNA, 19 bp, Artificial Sequence
  Description of Artificial Sequence: Chemically synthesized oligonucleotide
gtacgcccagcttcctgaa

SEQ ID NO: 2978 - DNA, 19 bp, Artificial Sequence
  Description of Artificial Sequence: Chemically synthesized oligonucleotide
ttcaggaagctgggcgtac

SEQ ID NO: 2979 - DNA, 19 bp, Artificial Sequence
  Description of Artificial Sequence: Chemically synthesized oligonucleotide
tacgcccagcttcctgaag

SEQ ID NO: 2980 - DNA, 19 bp, Artificial Sequence
  Description of Artificial Sequence: Chemically synthesized oligonucleotide
cttcaggaagctgggcgta

SEQ ID NO: 2981 - DNA, 19 bp, Artificial Sequence
  Description of Artificial Sequence: Chemically synthesized oligonucleotide
acgcccagcttcctgaagg

SEQ ID NO: 2982 - DNA, 19 bp, Artificial Sequence
  Description of Artificial Sequence: Chemically synthesized oligonucleotide
ccttcaggaagctgggcgt

SEQ ID NO: 2983 - DNA, 19 bp, Artificial Sequence
  Description of Artificial Sequence: Chemically synthesized oligonucleotide
cgcccagcttcctgaaggg

SEQ ID NO: 2984 - DNA, 19 bp, Artificial Sequence
  Description of Artificial Sequence: Chemically synthesized oligonucleotide
cccttcaggaagctgggcg

SEQ ID NO: 2985 - DNA, 19 bp, Artificial Sequence
  Description of Artificial Sequence: Chemically synthesized oligonucleotide
gcccagcttcctgaagggc

SEQ ID NO: 2986 - DNA, 19 bp, Artificial Sequence
  Description of Artificial Sequence: Chemically synthesized oligonucleotide
gcccttcaggaagctgggc

SEQ ID NO: 2987 - DNA, 19 bp, Artificial Sequence
  Description of Artificial Sequence: Chemically synthesized oligonucleotide
cccagcttcctgaagggca

SEQ ID NO: 2988 - DNA, 19 bp, Artificial Sequence
  Description of Artificial Sequence: Chemically synthesized oligonucleotide
tgcccttcaggaagctggg

SEQ ID NO: 2989 - DNA, 19 bp, Artificial Sequence
  Description of Artificial Sequence: Chemically synthesized oligonucleotide
ccagcttcctgaagggcac

SEQ ID NO: 2990 - DNA, 19 bp, Artificial Sequence
  Description of Artificial Sequence: Chemically synthesized oligonucleotide
gtgcccttcaggaagctgg

SEQ ID NO: 2991 - DNA, 19 bp, Artificial Sequence
  Description of Artificial Sequence: Chemically synthesized oligonucleotide
cagcttcctgaagggcacc

SEQ ID NO: 2992 - DNA, 19 bp, Artificial Sequence
  Description of Artificial Sequence: Chemically synthesized oligonucleotide
ggtgcccttcaggaagctg

SEQ ID NO: 2993 - DNA, 19 bp, Artificial Sequence
  Description of Artificial Sequence: Chemically synthesized oligonucleotide
agcttcctgaagggcaccc

SEQ ID NO: 2994 - DNA, 19 bp, Artificial Sequence
  Description of Artificial Sequence: Chemically synthesized oligonucleotide
gggtgcccttcaggaagct

SEQ ID NO: 2995 - DNA, 19 bp, Artificial Sequence
  Description of Artificial Sequence: Chemically synthesized oligonucleotide
gcttcctgaagggcacccc

SEQ ID NO: 2996 - DNA, 19 bp, Artificial Sequence
  Description of Artificial Sequence: Chemically synthesized oligonucleotide
ggggtgcccttcaggaagc

SEQ ID NO: 2997 - DNA, 19 bp, Artificial Sequence
  Description of Artificial Sequence: Chemically synthesized oligonucleotide
cttcctgaagggcacccca

SEQ ID NO: 2998 - DNA, 19 bp, Artificial Sequence
  Description of Artificial Sequence: Chemically synthesized oligonucleotide
tggggtgcccttcaggaag

SEQ ID NO: 2999 - DNA, 19 bp, Artificial Sequence
  Description of Artificial Sequence: Chemically synthesized oligonucleotide
ttcctgaagggcaccccaa

SEQ ID NO: 3000 - DNA, 19 bp, Artificial Sequence
  Description of Artificial Sequence: Chemically synthesized oligonucleotide
ttggggtgcccttcaggaa

SEQ ID NO: 3001 - DNA, 19 bp, Artificial Sequence
  Description of Artificial Sequence: Chemically synthesized oligonucleotide
tcctgaagggcaccccaac

SEQ ID NO: 3002 - DNA, 19 bp, Artificial Sequence
  Description of Artificial Sequence: Chemically synthesized oligonucleotide
gttggggtgcccttcagga

SEQ ID NO: 3003 - DNA, 19 bp, Artificial Sequence
  Description of Artificial Sequence: Chemically synthesized oligonucleotide
cctgaagggcaccccaacc

SEQ ID NO: 3004 - DNA, 19 bp, Artificial Sequence
  Description of Artificial Sequence: Chemically synthesized oligonucleotide
ggttggggtgcccttcagg

SEQ ID NO: 3005 - DNA, 19 bp, Artificial Sequence
  Description of Artificial Sequence: Chemically synthesized oligonucleotide
ctgaagggcaccccaacct

SEQ ID NO: 3006 - DNA, 19 bp, Artificial Sequence
  Description of Artificial Sequence: Chemically synthesized oligonucleotide
aggttggggtgcccttcag

SEQ ID NO: 3007 - DNA, 19 bp, Artificial Sequence
  Description of Artificial Sequence: Chemically synthesized oligonucleotide
tgaagggcaccccaacctg

SEQ ID NO: 3008 - DNA, 19 bp, Artificial Sequence
  Description of Artificial Sequence: Chemically synthesized oligonucleotide
caggttggggtgcccttca

SEQ ID NO: 3009 - DNA, 19 bp, Artificial Sequence
  Description of Artificial Sequence: Chemically synthesized oligonucleotide
gaagggcaccccaacctgg

SEQ ID NO: 3010 - DNA, 19 bp, Artificial Sequence
  Description of Artificial Sequence: Chemically synthesized oligonucleotide
ccaggttggggtgcccttc

SEQ ID NO: 3011 - DNA, 19 bp, Artificial Sequence
  Description of Artificial Sequence: Chemically synthesized oligonucleotide
aagggcaccccaacctggg

SEQ ID NO: 3012 - DNA, 19 bp, Artificial Sequence
  Description of Artificial Sequence: Chemically synthesized oligonucleotide
cccaggttggggtgccctt

SEQ ID NO: 3013 - DNA, 19 bp, Artificial Sequence
  Description of Artificial Sequence: Chemically synthesized oligonucleotide
agggcaccccaacctggga

SEQ ID NO: 3014 - DNA, 19 bp, Artificial Sequence
  Description of Artificial Sequence: Chemically synthesized oligonucleotide
tcccaggttggggtgccct

SEQ ID NO: 3015 - DNA, 19 bp, Artificial Sequence
  Description of Artificial Sequence: Chemically synthesized oligonucleotide
gggcaccccaacctgggag

SEQ ID NO: 3016 - DNA, 19 bp, Artificial Sequence
  Description of Artificial Sequence: Chemically synthesized oligonucleotide
ctcccaggttggggtgccc

SEQ ID NO: 3017 - DNA, 19 bp, Artificial Sequence
  Description of Artificial Sequence: Chemically synthesized oligonucleotide
ggcaccccaacctgggaga

SEQ ID NO: 3018 - DNA, 19 bp, Artificial Sequence
  Description of Artificial Sequence: Chemically synthesized oligonucleotide
tctcccaggttggggtgcc

SEQ ID NO: 3019 - DNA, 19 bp, Artificial Sequence
  Description of Artificial Sequence: Chemically synthesized oligonucleotide
gcaccccaacctgggagaa

SEQ ID NO: 3020 - DNA, 19 bp, Artificial Sequence
  Description of Artificial Sequence: Chemically synthesized oligonucleotide
ttctcccaggttggggtgc

SEQ ID NO: 3021 - DNA, 19 bp, Artificial Sequence
  Description of Artificial Sequence: Chemically synthesized oligonucleotide
caccccaacctgggagaag

SEQ ID NO: 3022 - DNA, 19 bp, Artificial Sequence
  Description of Artificial Sequence: Chemically synthesized oligonucleotide
cttctcccaggttggggtg

SEQ ID NO: 3023 - DNA, 19 bp, Artificial Sequence
  Description of Artificial Sequence: Chemically synthesized oligonucleotide
accccaacctgggagaaga

SEQ ID NO: 3024 - DNA, 19 bp, Artificial Sequence
  Description of Artificial Sequence: Chemically synthesized oligonucleotide
tcttctcccaggttggggt

SEQ ID NO: 3025 - DNA, 19 bp, Artificial Sequence
  Description of Artificial Sequence: Chemically synthesized oligonucleotide
ccccaacctgggagaagac

SEQ ID NO: 3026 - DNA, 19 bp, Artificial Sequence
  Description of Artificial Sequence: Chemically synthesized oligonucleotide
gtcttctcccaggttgggg

SEQ ID NO: 3027 - DNA, 19 bp, Artificial Sequence
  Description of Artificial Sequence: Chemically synthesized oligonucleotide
cccaacctgggagaagacg

SEQ ID NO: 3028 - DNA, 19 bp, Artificial Sequence
  Description of Artificial Sequence: Chemically synthesized oligonucleotide
cgtcttctcccaggttggg

SEQ ID NO: 3029 - DNA, 19 bp, Artificial Sequence
  Description of Artificial Sequence: Chemically synthesized oligonucleotide
ccaacctgggagaagacgg

SEQ ID NO: 3030 - DNA, 19 bp, Artificial Sequence
  Description of Artificial Sequence: Chemically synthesized oligonucleotide
ccgtcttctcccaggttgg

SEQ ID NO: 3031 - DNA, 19 bp, Artificial Sequence
  Description of Artificial Sequence: Chemically synthesized oligonucleotide
caacctgggagaagacggc

SEQ ID NO: 3032 - DNA, 19 bp, Artificial Sequence
  Description of Artificial Sequence: Chemically synthesized oligonucleotide
gccgtcttctcccaggttg

SEQ ID NO: 3033 - DNA, 19 bp, Artificial Sequence
  Description of Artificial Sequence: Chemically synthesized oligonucleotide
aacctgggagaagacggcc

SEQ ID NO: 3034 - DNA, 19 bp, Artificial Sequence
  Description of Artificial Sequence: Chemically synthesized oligonucleotide
ggccgtcttctcccaggtt

SEQ ID NO: 3035 - DNA, 19 bp, Artificial Sequence
  Description of Artificial Sequence: Chemically synthesized oligonucleotide
acctgggagaagacggccc

SEQ ID NO: 3036 - DNA, 19 bp, Artificial Sequence
  Description of Artificial Sequence: Chemically synthesized oligonucleotide
gggccgtcttctcccaggt

SEQ ID NO: 3037 - DNA, 19 bp, Artificial Sequence
  Description of Artificial Sequence: Chemically synthesized oligonucleotide
cctgggagaagacggcccc

SEQ ID NO: 3038 - DNA, 19 bp, Artificial Sequence
  Description of Artificial Sequence: Chemically synthesized oligonucleotide
ggggccgtcttctcccagg

SEQ ID NO: 3039 - DNA, 19 bp, Artificial Sequence
  Description of Artificial Sequence: Chemically synthesized oligonucleotide
ctgggagaagacggcccca

SEQ ID NO: 3040 - DNA, 19 bp, Artificial Sequence
  Description of Artificial Sequence: Chemically synthesized oligonucleotide
tggggccgtcttctcccag

SEQ ID NO: 3041 - DNA, 19 bp, Artificial Sequence
  Description of Artificial Sequence: Chemically synthesized oligonucleotide
tgggagaagacggccccag

SEQ ID NO: 3042 - DNA, 19 bp, Artificial Sequence
  Description of Artificial Sequence: Chemically synthesized oligonucleotide
ctggggccgtcttctccca

SEQ ID NO: 3043 - DNA, 19 bp, Artificial Sequence
  Description of Artificial Sequence: Chemically synthesized oligonucleotide
gggagaagacggccccaga

SEQ ID NO: 3044 - DNA, 19 bp, Artificial Sequence
  Description of Artificial Sequence: Chemically synthesized oligonucleotide
tctggggccgtcttctccc

SEQ ID NO: 3045 - DNA, 19 bp, Artificial Sequence
  Description of Artificial Sequence: Chemically synthesized oligonucleotide
ggagaagacggccccagag

SEQ ID NO: 3046 - DNA, 19 bp, Artificial Sequence
  Description of Artificial Sequence: Chemically synthesized oligonucleotide
ctctggggccgtcttctcc

SEQ ID NO: 3047 - DNA, 19 bp, Artificial Sequence
  Description of Artificial Sequence: Chemically synthesized oligonucleotide
gagaagacggccccagaga

SEQ ID NO: 3048 - DNA, 19 bp, Artificial Sequence
  Description of Artificial Sequence: Chemically synthesized oligonucleotide
tctctggggccgtcttctc

SEQ ID NO: 3049 - DNA, 19 bp, Artificial Sequence
  Description of Artificial Sequence: Chemically synthesized oligonucleotide
agaagacggccccagagaa

SEQ ID NO: 3050 - DNA, 19 bp, Artificial Sequence
  Description of Artificial Sequence: Chemically synthesized oligonucleotide
ttctctggggccgtcttct

SEQ ID NO: 3051 - DNA, 19 bp, Artificial Sequence
  Description of Artificial Sequence: Chemically synthesized oligonucleotide
gaagacggccccagagaac

SEQ ID NO: 3052 - DNA, 19 bp, Artificial Sequence
  Description of Artificial Sequence: Chemically synthesized oligonucleotide
gttctctggggccgtcttc

SEQ ID NO: 3053 - DNA, 19 bp, Artificial Sequence
  Description of Artificial Sequence: Chemically synthesized oligonucleotide
aagacggccccagagaacg

SEQ ID NO: 3054 - DNA, 19 bp, Artificial Sequence
  Description of Artificial Sequence: Chemically synthesized oligonucleotide
cgttctctggggccgtctt

SEQ ID NO: 3055 - DNA, 19 bp, Artificial Sequence
  Description of Artificial Sequence: Chemically synthesized oligonucleotide
agacggccccagagaacgg

SEQ ID NO: 3056 - DNA, 19 bp, Artificial Sequence
  Description of Artificial Sequence: Chemically synthesized oligonucleotide
ccgttctctggggccgtct

SEQ ID NO: 3057 - DNA, 19 bp, Artificial Sequence
  Description of Artificial Sequence: Chemically synthesized oligonucleotide
gacggccccagagaacggc

SEQ ID NO: 3058 - DNA, 19 bp, Artificial Sequence
  Description of Artificial Sequence: Chemically synthesized oligonucleotide
gccgttctctggggccgtc

SEQ ID NO: 3059 - DNA, 19 bp, Artificial Sequence
  Description of Artificial Sequence: Chemically synthesized oligonucleotide
acggccccagagaacggca

SEQ ID NO: 3060 - DNA, 19 bp, Artificial Sequence
  Description of Artificial Sequence: Chemically synthesized oligonucleotide
tgccgttctctggggccgt

SEQ ID NO: 3061 - DNA, 19 bp, Artificial Sequence
  Description of Artificial Sequence: Chemically synthesized oligonucleotide
cggccccagagaacggcat

SEQ ID NO: 3062 - DNA, 19 bp, Artificial Sequence
  Description of Artificial Sequence: Chemically synthesized oligonucleotide
atgccgttctctggggccg

SEQ ID NO: 3063 - DNA, 19 bp, Artificial Sequence
  Description of Artificial Sequence: Chemically synthesized oligonucleotide
ggccccagagaacggcatc

SEQ ID NO: 3064 - DNA, 19 bp, Artificial Sequence
  Description of Artificial Sequence: Chemically synthesized oligonucleotide
gatgccgttctctggggcc

SEQ ID NO: 3065 - DNA, 19 bp, Artificial Sequence
  Description of Artificial Sequence: Chemically synthesized oligonucleotide
gccccagagaacggcatcg

SEQ ID NO: 3066 - DNA, 19 bp, Artificial Sequence
  Description of Artificial Sequence: Chemically synthesized oligonucleotide
cgatgccgttctctggggc

SEQ ID NO: 3067 - DNA, 19 bp, Artificial Sequence
  Description of Artificial Sequence: Chemically synthesized oligonucleotide
ccccagagaacggcatcgt

SEQ ID NO: 3068 - DNA, 19 bp, Artificial Sequence
  Description of Artificial Sequence: Chemically synthesized oligonucleotide
acgatgccgttctctgggg

SEQ ID NO: 3069 - DNA, 19 bp, Artificial Sequence
  Description of Artificial Sequence: Chemically synthesized oligonucleotide
cccagagaacggcatcgtg

SEQ ID NO: 3070 - DNA, 19 bp, Artificial Sequence
  Description of Artificial Sequence: Chemically synthesized oligonucleotide
cacgatgccgttctctggg

SEQ ID NO: 3071 - DNA, 19 bp, Artificial Sequence
  Description of Artificial Sequence: Chemically synthesized oligonucleotide
ccagagaacggcatcgtga

SEQ ID NO: 3072 - DNA, 19 bp, Artificial Sequence
  Description of Artificial Sequence: Chemically synthesized oligonucleotide
tcacgatgccgttctctgg

SEQ ID NO: 3073 - DNA, 19 bp, Artificial Sequence
  Description of Artificial Sequence: Chemically synthesized oligonucleotide
cagagaacggcatcgtgag

SEQ ID NO: 3074 - DNA, 19 bp, Artificial Sequence
  Description of Artificial Sequence: Chemically synthesized oligonucleotide
ctcacgatgccgttctctg

SEQ ID NO: 3075 - DNA, 19 bp, Artificial Sequence
  Description of Artificial Sequence: Chemically synthesized oligonucleotide
agagaacggcatcgtgaga

SEQ ID NO: 3076 - DNA, 19 bp, Artificial Sequence
  Description of Artificial Sequence: Chemically synthesized oligonucleotide
tctcacgatgccgttctct

SEQ ID NO: 3077 - DNA, 19 bp, Artificial Sequence
  Description of Artificial Sequence: Chemically synthesized oligonucleotide
gagaacggcatcgtgagac

SEQ ID NO: 3078 - DNA, 19 bp, Artificial Sequence
  Description of Artificial Sequence: Chemically synthesized oligonucleotide
gtctcacgatgccgttctc

SEQ ID NO: 3079 - DNA, 19 bp, Artificial Sequence
  Description of Artificial Sequence: Chemically synthesized oligonucleotide
agaacggcatcgtgagaca

SEQ ID NO: 3080 - DNA, 19 bp, Artificial Sequence
  Description of Artificial Sequence: Chemically synthesized oligonucleotide
tgtctcacgatgccgttct

SEQ ID NO: 3081 - DNA, 19 bp, Artificial Sequence
  Description of Artificial Sequence: Chemically synthesized oligonucleotide
gaacggcatcgtgagacag

SEQ ID NO: 3082 - DNA, 19 bp, Artificial Sequence
  Description of Artificial Sequence: Chemically synthesized oligonucleotide
ctgtctcacgatgccgttc

SEQ ID NO: 3083 - DNA, 19 bp, Artificial Sequence
  Description of Artificial Sequence: Chemically synthesized oligonucleotide
aacggcatcgtgagacagg

SEQ ID NO: 3084 - DNA, 19 bp, Artificial Sequence
  Description of Artificial Sequence: Chemically synthesized oligonucleotide
cctgtctcacgatgccgtt

SEQ ID NO: 3085 - DNA, 19 bp, Artificial Sequence
  Description of Artificial Sequence: Chemically synthesized oligonucleotide
acggcatcgtgagacagga

SEQ ID NO: 3086 - DNA, 19 bp, Artificial Sequence
  Description of Artificial Sequence: Chemically synthesized oligonucleotide
tcctgtctcacgatgccgt

SEQ ID NO: 3087 - DNA, 19 bp, Artificial Sequence
  Description of Artificial Sequence: Chemically synthesized oligonucleotide
cggcatcgtgagacaggag

SEQ ID NO: 3088 - DNA, 19 bp, Artificial Sequence
  Description of Artificial Sequence: Chemically synthesized oligonucleotide
ctcctgtctcacgatgccg

SEQ ID NO: 3089 - DNA, 19 bp, Artificial Sequence
  Description of Artificial Sequence: Chemically synthesized oligonucleotide
ggcatcgtgagacaggagc

SEQ ID NO: 3090 - DNA, 19 bp, Artificial Sequence
  Description of Artificial Sequence: Chemically synthesized oligonucleotide
gctcctgtctcacgatgcc

SEQ ID NO: 3091 - DNA, 19 bp, Artificial Sequence
  Description of Artificial Sequence: Chemically synthesized oligonucleotide
gcatcgtgagacaggagcc

SEQ ID NO: 3092 - DNA, 19 bp, Artificial Sequence
  Description of Artificial Sequence: Chemically synthesized oligonucleotide
ggctcctgtctcacgatgc

SEQ ID NO: 3093 - DNA, 19 bp, Artificial Sequence
  Description of Artificial Sequence: Chemically synthesized oligonucleotide
catcgtgagacaggagccc

SEQ ID NO: 3094 - DNA, 19 bp, Artificial Sequence
  Description of Artificial Sequence: Chemically synthesized oligonucleotide
gggctcctgtctcacgatg

SEQ ID NO: 3095 - DNA, 19 bp, Artificial Sequence
  Description of Artificial Sequence: Chemically synthesized oligonucleotide
atcgtgagacaggagcccg

SEQ ID NO: 3096 - DNA, 19 bp, Artificial Sequence
  Description of Artificial Sequence: Chemically synthesized oligonucleotide
cgggctcctgtctcacgat

SEQ ID NO: 3097 - DNA, 19 bp, Artificial Sequence
  Description of Artificial Sequence: Chemically synthesized oligonucleotide
tcgtgagacaggagcccgg

SEQ ID NO: 3098 - DNA, 19 bp, Artificial Sequence
  Description of Artificial Sequence: Chemically synthesized oligonucleotide
ccgggctcctgtctcacga

SEQ ID NO: 3099 - DNA, 19 bp, Artificial Sequence
  Description of Artificial Sequence: Chemically synthesized oligonucleotide
cgtgagacaggagcccggc

SEQ ID NO: 3100 - DNA, 19 bp, Artificial Sequence
  Description of Artificial Sequence: Chemically synthesized oligonucleotide
gccgggctcctgtctcacg

SEQ ID NO: 3101 - DNA, 19 bp, Artificial Sequence
  Description of Artificial Sequence: Chemically synthesized oligonucleotide
gtgagacaggagcccggca

SEQ ID NO: 3102 - DNA, 19 bp, Artificial Sequence
  Description of Artificial Sequence: Chemically synthesized oligonucleotide
tgccgggctcctgtctcac

SEQ ID NO: 3103 - DNA, 19 bp, Artificial Sequence
  Description of Artificial Sequence: Chemically synthesized oligonucleotide
tgagacaggagcccggcag

SEQ ID NO: 3104 - DNA, 19 bp, Artificial Sequence
  Description of Artificial Sequence: Chemically synthesized oligonucleotide
ctgccgggctcctgtctca

SEQ ID NO: 3105 - DNA, 19 bp, Artificial Sequence
  Description of Artificial Sequence: Chemically synthesized oligonucleotide
gagacaggagcccggcagc

SEQ ID NO: 3106 - DNA, 19 bp, Artificial Sequence
  Description of Artificial Sequence: Chemically synthesized oligonucleotide
gctgccgggctcctgtctc

SEQ ID NO: 3107 - DNA, 19 bp, Artificial Sequence
  Description of Artificial Sequence: Chemically synthesized oligonucleotide
agacaggagcccggcagcc

SEQ ID NO: 3108 - DNA, 19 bp, Artificial Sequence
  Description of Artificial Sequence: Chemically synthesized oligonucleotide
ggctgccgggctcctgtct

SEQ ID NO: 3109 - DNA, 19 bp, Artificial Sequence
  Description of Artificial Sequence: Chemically synthesized oligonucleotide
gacaggagcccggcagccc

SEQ ID NO: 3110 - DNA, 19 bp, Artificial Sequence
  Description of Artificial Sequence: Chemically synthesized oligonucleotide
gggctgccgggctcctgtc

SEQ ID NO: 3111 - DNA, 19 bp, Artificial Sequence
  Description of Artificial Sequence: Chemically synthesized oligonucleotide
acaggagcccggcagcccg

SEQ ID NO: 3112 - DNA, 19 bp, Artificial Sequence
  Description of Artificial Sequence: Chemically synthesized oligonucleotide
cgggctgccgggctcctgt

SEQ ID NO: 3113 - DNA, 19 bp, Artificial Sequence
  Description of Artificial Sequence: Chemically synthesized oligonucleotide
caggagcccggcagcccgc

SEQ ID NO: 3114 - DNA, 19 bp, Artificial Sequence
  Description of Artificial Sequence: Chemically synthesized oligonucleotide
gcgggctgccgggctcctg

SEQ ID NO: 3115 - DNA, 19 bp, Artificial Sequence
  Description of Artificial Sequence: Chemically synthesized oligonucleotide
aggagcccggcagcccgcc

SEQ ID NO: 3116 - DNA, 19 bp, Artificial Sequence
  Description of Artificial Sequence: Chemically synthesized oligonucleotide
ggcgggctgccgggctcct

SEQ ID NO: 3117 - DNA, 19 bp, Artificial Sequence
  Description of Artificial Sequence: Chemically synthesized oligonucleotide
ggagcccggcagcccgcct

SEQ ID NO: 3118 - DNA, 19 bp, Artificial Sequence
  Description of Artificial Sequence: Chemically synthesized oligonucleotide
aggcgggctgccgggctcc

SEQ ID NO: 3119 - DNA, 19 bp, Artificial Sequence
  Description of Artificial Sequence: Chemically synthesized oligonucleotide
gagcccggcagcccgcctc

SEQ ID NO: 3120 - DNA, 19 bp, Artificial Sequence
  Description of Artificial Sequence: Chemically synthesized oligonucleotide
gaggcgggctgccgggctc

SEQ ID NO: 3121 - DNA, 19 bp, Artificial Sequence
  Description of Artificial Sequence: Chemically synthesized oligonucleotide
agcccggcagcccgcctcg

SEQ ID NO: 3122 - DNA, 19 bp, Artificial Sequence
  Description of Artificial Sequence: Chemically synthesized oligonucleotide
cgaggcgggctgccgggct

SEQ ID NO: 3123 - DNA, 19 bp, Artificial Sequence
  Description of Artificial Sequence: Chemically synthesized oligonucleotide
gcccggcagcccgcctcga

SEQ ID NO: 3124 - DNA, 19 bp, Artificial Sequence
  Description of Artificial Sequence: Chemically synthesized oligonucleotide
tcgaggcgggctgccgggc

SEQ ID NO: 3125 - DNA, 19 bp, Artificial Sequence
  Description of Artificial Sequence: Chemically synthesized oligonucleotide
cccggcagcccgcctcgag

SEQ ID NO: 3126 - DNA, 19 bp, Artificial Sequence
  Description of Artificial Sequence: Chemically synthesized oligonucleotide
ctcgaggcgggctgccggg

SEQ ID NO: 3127 - DNA, 19 bp, Artificial Sequence
  Description of Artificial Sequence: Chemically synthesized oligonucleotide
ccggcagcccgcctcgaga

SEQ ID NO: 3128 - DNA, 19 bp, Artificial Sequence
  Description of Artificial Sequence: Chemically synthesized oligonucleotide
tctcgaggcgggctgccgg

SEQ ID NO: 3129 - DNA, 19 bp, Artificial Sequence
  Description of Artificial Sequence: Chemically synthesized oligonucleotide
cggcagcccgcctcgagat

SEQ ID NO: 3130 - DNA, 19 bp, Artificial Sequence
  Description of Artificial Sequence: Chemically synthesized oligonucleotide
atctcgaggcgggctgccg

SEQ ID NO: 3131 - DNA, 19 bp, Artificial Sequence
  Description of Artificial Sequence: Chemically synthesized oligonucleotide
ggcagcccgcctcgagatg

SEQ ID NO: 3132 - DNA, 19 bp, Artificial Sequence
  Description of Artificial Sequence: Chemically synthesized oligonucleotide
catctcgaggcgggctgcc

SEQ ID NO: 3133 - DNA, 19 bp, Artificial Sequence
  Description of Artificial Sequence: Chemically synthesized oligonucleotide
gcagcccgcctcgagatgg

SEQ ID NO: 3134 - DNA, 19 bp, Artificial Sequence
  Description of Artificial Sequence: Chemically synthesized oligonucleotide
ccatctcgaggcgggctgc

SEQ ID NO: 3135 - DNA, 19 bp, Artificial Sequence
  Description of Artificial Sequence: Chemically synthesized oligonucleotide
cagcccgcctcgagatgga

SEQ ID NO: 3136 - DNA, 19 bp, Artificial Sequence
  Description of Artificial Sequence: Chemically synthesized oligonucleotide
tccatctcgaggcgggctg

SEQ ID NO: 3137 - DNA, 19 bp, Artificial Sequence
  Description of Artificial Sequence: Chemically synthesized oligonucleotide
agcccgcctcgagatggac

SEQ ID NO: 3138 - DNA, 19 bp, Artificial Sequence
  Description of Artificial Sequence: Chemically synthesized oligonucleotide
gtccatctcgaggcgggct

SEQ ID NO: 3139 - DNA, 19 bp, Artificial Sequence
  Description of Artificial Sequence: Chemically synthesized oligonucleotide
gcccgcctcgagatggact

SEQ ID NO: 3140 - DNA, 19 bp, Artificial Sequence
  Description of Artificial Sequence: Chemically synthesized oligonucleotide
agtccatctcgaggcgggc

SEQ ID NO: 3141 - DNA, 19 bp, Artificial Sequence
  Description of Artificial Sequence: Chemically synthesized oligonucleotide
cccgcctcgagatggactg

SEQ ID NO: 3142 - DNA, 19 bp, Artificial Sequence
  Description of Artificial Sequence: Chemically synthesized oligonucleotide
cagtccatctcgaggcggg

SEQ ID NO: 3143 - DNA, 19 bp, Artificial Sequence
  Description of Artificial Sequence: Chemically synthesized oligonucleotide
ccgcctcgagatggactgc

SEQ ID NO: 3144 - DNA, 19 bp, Artificial Sequence
  Description of Artificial Sequence: Chemically synthesized oligonucleotide
gcagtccatctcgaggcgg

SEQ ID NO: 3145 - DNA, 19 bp, Artificial Sequence
  Description of Artificial Sequence: Chemically synthesized oligonucleotide
cgcctcgagatggactgca

SEQ ID NO: 3146 - DNA, 19 bp, Artificial Sequence
  Description of Artificial Sequence: Chemically synthesized oligonucleotide
tgcagtccatctcgaggcg

SEQ ID NO: 3147 - DNA, 19 bp, Artificial Sequence
  Description of Artificial Sequence: Chemically synthesized oligonucleotide
gcctcgagatggactgcac

SEQ ID NO: 3148 - DNA, 19 bp, Artificial Sequence
  Description of Artificial Sequence: Chemically synthesized oligonucleotide
gtgcagtccatctcgaggc

SEQ ID NO: 3149 - DNA, 19 bp, Artificial Sequence
  Description of Artificial Sequence: Chemically synthesized oligonucleotide
cctcgagatggactgcacc

SEQ ID NO: 3150 - DNA, 19 bp, Artificial Sequence
  Description of Artificial Sequence: Chemically synthesized oligonucleotide
ggtgcagtccatctcgagg

SEQ ID NO: 3151 - DNA, 19 bp, Artificial Sequence
  Description of Artificial Sequence: Chemically synthesized oligonucleotide
ctcgagatggactgcacca

SEQ ID NO: 3152 - DNA, 19 bp, Artificial Sequence
  Description of Artificial Sequence: Chemically synthesized oligonucleotide
tggtgcagtccatctcgag

SEQ ID NO: 3153 - DNA, 19 bp, Artificial Sequence
  Description of Artificial Sequence: Chemically synthesized oligonucleotide
tcgagatggactgcaccat

SEQ ID NO: 3154 - DNA, 19 bp, Artificial Sequence
  Description of Artificial Sequence: Chemically synthesized oligonucleotide
atggtgcagtccatctcga

SEQ ID NO: 3155 - DNA, 19 bp, Artificial Sequence
  Description of Artificial Sequence: Chemically synthesized oligonucleotide
cgagatggactgcaccatg

SEQ ID NO: 3156 - DNA, 19 bp, Artificial Sequence
  Description of Artificial Sequence: Chemically synthesized oligonucleotide
catggtgcagtccatctcg

SEQ ID NO: 3157 - DNA, 19 bp, Artificial Sequence
  Description of Artificial Sequence: Chemically synthesized oligonucleotide
gagatggactgcaccatgg

SEQ ID NO: 3158 - DNA, 19 bp, Artificial Sequence
  Description of Artificial Sequence: Chemically synthesized oligonucleotide
ccatggtgcagtccatctc

SEQ ID NO: 3159 - DNA, 19 bp, Artificial Sequence
  Description of Artificial Sequence: Chemically synthesized oligonucleotide
agatggactgcaccatggg

SEQ ID NO: 3160 - DNA, 19 bp, Artificial Sequence
  Description of Artificial Sequence: Chemically synthesized oligonucleotide
cccatggtgcagtccatct

SEQ ID NO: 3161 - DNA, 19 bp, Artificial Sequence
  Description of Artificial Sequence: Chemically synthesized oligonucleotide
gatggactgcaccatgggc

SEQ ID NO: 3162 - DNA, 19 bp, Artificial Sequence
  Description of Artificial Sequence: Chemically synthesized oligonucleotide
gcccatggtgcagtccatc

SEQ ID NO: 3163 - DNA, 19 bp, Artificial Sequence
  Description of Artificial Sequence: Chemically synthesized oligonucleotide
atggactgcaccatgggcc

SEQ ID NO: 3164 - DNA, 19 bp, Artificial Sequence
  Description of Artificial Sequence: Chemically synthesized oligonucleotide
ggcccatggtgcagtccat

SEQ ID NO: 3165 - DNA, 19 bp, Artificial Sequence
  Description of Artificial Sequence: Chemically synthesized oligonucleotide
tggactgcaccatgggccg

SEQ ID NO: 3166 - DNA, 19 bp, Artificial Sequence
  Description of Artificial Sequence: Chemically synthesized oligonucleotide
cggcccatggtgcagtcca

SEQ ID NO: 3167 - DNA, 19 bp, Artificial Sequence
  Description of Artificial Sequence: Chemically synthesized oligonucleotide
ggactgcaccatgggccgc

SEQ ID NO: 3168 - DNA, 19 bp, Artificial Sequence
  Description of Artificial Sequence: Chemically synthesized oligonucleotide
gcggcccatggtgcagtcc

SEQ ID NO: 3169 - DNA, 19 bp, Artificial Sequence
  Description of Artificial Sequence: Chemically synthesized oligonucleotide
gactgcaccatgggccgct

SEQ ID NO: 3170 - DNA, 19 bp, Artificial Sequence
  Description of Artificial Sequence: Chemically synthesized oligonucleotide
agcggcccatggtgcagtc

SEQ ID NO: 3171 - DNA, 19 bp, Artificial Sequence
  Description of Artificial Sequence: Chemically synthesized oligonucleotide
actgcaccatgggccgctg

SEQ ID NO: 3172 - DNA, 19 bp, Artificial Sequence
  Description of Artificial Sequence: Chemically synthesized oligonucleotide
cagcggcccatggtgcagt

SEQ ID NO: 3173 - DNA, 19 bp, Artificial Sequence
  Description of Artificial Sequence: Chemically synthesized oligonucleotide
ctgcaccatgggccgctgt

SEQ ID NO: 3174 - DNA, 19 bp, Artificial Sequence
  Description of Artificial Sequence: Chemically synthesized oligonucleotide
acagcggcccatggtgcag

SEQ ID NO: 3175 - DNA, 19 bp, Artificial Sequence
  Description of Artificial Sequence: Chemically synthesized oligonucleotide
tgcaccatgggccgctgtg

SEQ ID NO: 3176 - DNA, 19 bp, Artificial Sequence
  Description of Artificial Sequence: Chemically synthesized oligonucleotide
cacagcggcccatggtgca

SEQ ID NO: 3177 - DNA, 19 bp, Artificial Sequence
  Description of Artificial Sequence: Chemically synthesized oligonucleotide
gcaccatgggccgctgtgc

SEQ ID NO: 3178 - DNA, 19 bp, Artificial Sequence
  Description of Artificial Sequence: Chemically synthesized oligonucleotide
gcacagcggcccatggtgc

SEQ ID NO: 3179 - DNA, 19 bp, Artificial Sequence
  Description of Artificial Sequence: Chemically synthesized oligonucleotide
caccatgggccgctgtgcc

SEQ ID NO: 3180 - DNA, 19 bp, Artificial Sequence
  Description of Artificial Sequence: Chemically synthesized oligonucleotide
ggcacagcggcccatggtg

SEQ ID NO: 3181 - DNA, 19 bp, Artificial Sequence
  Description of Artificial Sequence: Chemically synthesized oligonucleotide
accatgggccgctgtgcct

SEQ ID NO: 3182 - DNA, 19 bp, Artificial Sequence
  Description of Artificial Sequence: Chemically synthesized oligonucleotide
aggcacagcggcccatggt

SEQ ID NO: 3183 - DNA, 19 bp, Artificial Sequence
  Description of Artificial Sequence: Chemically synthesized oligonucleotide
ccatgggccgctgtgcctg

SEQ ID NO: 3184 - DNA, 19 bp, Artificial Sequence
  Description of Artificial Sequence: Chemically synthesized oligonucleotide
caggcacagcggcccatgg

SEQ ID NO: 3185 - DNA, 19 bp, Artificial Sequence
  Description of Artificial Sequence: Chemically synthesized oligonucleotide
catgggccgctgtgcctgg

SEQ ID NO: 3186 - DNA, 19 bp, Artificial Sequence
  Description of Artificial Sequence: Chemically synthesized oligonucleotide
ccaggcacagcggcccatg

SEQ ID NO: 3187 - DNA, 19 bp, Artificial Sequence
  Description of Artificial Sequence: Chemically synthesized oligonucleotide
atgggccgctgtgcctggg

SEQ ID NO: 3188 - DNA, 19 bp, Artificial Sequence
  Description of Artificial Sequence: Chemically synthesized oligonucleotide
cccaggcacagcggcccat

SEQ ID NO: 3189 - DNA, 19 bp, Artificial Sequence
  Description of Artificial Sequence: Chemically synthesized oligonucleotide
tgggccgctgtgcctggga

SEQ ID NO: 3190 - DNA, 19 bp, Artificial Sequence
  Description of Artificial Sequence: Chemically synthesized oligonucleotide
tcccaggcacagcggccca

SEQ ID NO: 3191 - DNA, 19 bp, Artificial Sequence
  Description of Artificial Sequence: Chemically synthesized oligonucleotide
gggccgctgtgcctgggag

SEQ ID NO: 3192 - DNA, 19 bp, Artificial Sequence
  Description of Artificial Sequence: Chemically synthesized oligonucleotide
ctcccaggcacagcggccc

SEQ ID NO: 3193 - DNA, 19 bp, Artificial Sequence
  Description of Artificial Sequence: Chemically synthesized oligonucleotide
ggccgctgtgcctgggaga

SEQ ID NO: 3194 - DNA, 19 bp, Artificial Sequence
  Description of Artificial Sequence: Chemically synthesized oligonucleotide
tctcccaggcacagcggcc

SEQ ID NO: 3195 - DNA, 19 bp, Artificial Sequence
  Description of Artificial Sequence: Chemically synthesized oligonucleotide
gccgctgtgcctgggagag

SEQ ID NO: 3196 - DNA, 19 bp, Artificial Sequence
  Description of Artificial Sequence: Chemically synthesized oligonucleotide
ctctcccaggcacagcggc

SEQ ID NO: 3197 - DNA, 19 bp, Artificial Sequence
  Description of Artificial Sequence: Chemically synthesized oligonucleotide
ccgctgtgcctgggagagc

SEQ ID NO: 3198 - DNA, 19 bp, Artificial Sequence
  Description of Artificial Sequence: Chemically synthesized oligonucleotide
gctctcccaggcacagcgg

SEQ ID NO: 3199 - DNA, 19 bp, Artificial Sequence
  Description of Artificial Sequence: Chemically synthesized oligonucleotide
cgctgtgcctgggagagcc

SEQ ID NO: 3200 - DNA, 19 bp, Artificial Sequence
  Description of Artificial Sequence: Chemically synthesized oligonucleotide
ggctctcccaggcacagcg

SEQ ID NO: 3201 - DNA, 19 bp, Artificial Sequence
  Description of Artificial Sequence: Chemically synthesized oligonucleotide
gctgtgcctgggagagcct

SEQ ID NO: 3202 - DNA, 19 bp, Artificial Sequence
  Description of Artificial Sequence: Chemically synthesized oligonucleotide
aggctctcccaggcacagc

SEQ ID NO: 3203 - DNA, 19 bp, Artificial Sequence
  Description of Artificial Sequence: Chemically synthesized oligonucleotide
ctgtgcctgggagagcctg

SEQ ID NO: 3204 - DNA, 19 bp, Artificial Sequence
  Description of Artificial Sequence: Chemically synthesized oligonucleotide
caggctctcccaggcacag

SEQ ID NO: 3205 - DNA, 19 bp, Artificial Sequence
  Description of Artificial Sequence: Chemically synthesized oligonucleotide
tgtgcctgggagagcctgc

SEQ ID NO: 3206 - DNA, 19 bp, Artificial Sequence
  Description of Artificial Sequence: Chemically synthesized oligonucleotide
gcaggctctcccaggcaca

SEQ ID NO: 3207 - DNA, 19 bp, Artificial Sequence
  Description of Artificial Sequence: Chemically synthesized oligonucleotide
gtgcctgggagagcctgct

SEQ ID NO: 3208 - DNA, 19 bp, Artificial Sequence
  Description of Artificial Sequence: Chemically synthesized oligonucleotide
agcaggctctcccaggcac

SEQ ID NO: 3209 - DNA, 19 bp, Artificial Sequence
  Description of Artificial Sequence: Chemically synthesized oligonucleotide
tgcctgggagagcctgctc

SEQ ID NO: 3210 - DNA, 19 bp, Artificial Sequence
  Description of Artificial Sequence: Chemically synthesized oligonucleotide
gagcaggctctcccaggca

SEQ ID NO: 3211 - DNA, 19 bp, Artificial Sequence
  Description of Artificial Sequence: Chemically synthesized oligonucleotide
gcctgggagagcctgctcc

SEQ ID NO: 3212 - DNA, 19 bp, Artificial Sequence
  Description of Artificial Sequence: Chemically synthesized oligonucleotide
ggagcaggctctcccaggc

SEQ ID NO: 3213 - DNA, 19 bp, Artificial Sequence
  Description of Artificial Sequence: Chemically synthesized oligonucleotide
cctgggagagcctgctccc

SEQ ID NO: 3214 - DNA, 19 bp, Artificial Sequence
  Description of Artificial Sequence: Chemically synthesized oligonucleotide
gggagcaggctctcccagg

SEQ ID NO: 3215 - DNA, 19 bp, Artificial Sequence
  Description of Artificial Sequence: Chemically synthesized oligonucleotide
ctgggagagcctgctccct

SEQ ID NO: 3216 - DNA, 19 bp, Artificial Sequence
  Description of Artificial Sequence: Chemically synthesized oligonucleotide
agggagcaggctctcccag

SEQ ID NO: 3217 - DNA, 19 bp, Artificial Sequence
  Description of Artificial Sequence: Chemically synthesized oligonucleotide
tgggagagcctgctccctt

SEQ ID NO: 3218 - DNA, 19 bp, Artificial Sequence
  Description of Artificial Sequence: Chemically synthesized oligonucleotide
aagggagcaggctctccca

SEQ ID NO: 3219 - DNA, 19 bp, Artificial Sequence
  Description of Artificial Sequence: Chemically synthesized oligonucleotide
gggagagcctgctcccttt

SEQ ID NO: 3220 - DNA, 19 bp, Artificial Sequence
  Description of Artificial Sequence: Chemically synthesized oligonucleotide
aaagggagcaggctctccc

SEQ ID NO: 3221 - DNA, 19 bp, Artificial Sequence
  Description of Artificial Sequence: Chemically synthesized oligonucleotide
ggagagcctgctccctttt

SEQ ID NO: 3222 - DNA, 19 bp, Artificial Sequence
  Description of Artificial Sequence: Chemically synthesized oligonucleotide
aaaagggagcaggctctcc

SEQ ID NO: 3223 - DNA, 19 bp, Artificial Sequence
  Description of Artificial Sequence: Chemically synthesized oligonucleotide
gagagcctgctcccttttg

SEQ ID NO: 3224 - DNA, 19 bp, Artificial Sequence
  Description of Artificial Sequence: Chemically synthesized oligonucleotide
caaaagggagcaggctctc

SEQ ID NO: 3225 - DNA, 19 bp, Artificial Sequence
  Description of Artificial Sequence: Chemically synthesized oligonucleotide
agagcctgctcccttttgg

SEQ ID NO: 3226 - DNA, 19 bp, Artificial Sequence
  Description of Artificial Sequence: Chemically synthesized oligonucleotide
ccaaaagggagcaggctct

SEQ ID NO: 3227 - DNA, 19 bp, Artificial Sequence
  Description of Artificial Sequence: Chemically synthesized oligonucleotide
gagcctgctcccttttgga

SEQ ID NO: 3228 - DNA, 19 bp, Artificial Sequence
  Description of Artificial Sequence: Chemically synthesized oligonucleotide
tccaaaagggagcaggctc

SEQ ID NO: 3229 - DNA, 19 bp, Artificial Sequence
  Description of Artificial Sequence: Chemically synthesized oligonucleotide
agcctgctcccttttggag

SEQ ID NO: 3230 - DNA, 19 bp, Artificial Sequence
  Description of Artificial Sequence: Chemically synthesized oligonucleotide
ctccaaaagggagcaggct

SEQ ID NO: 3231 - DNA, 19 bp, Artificial Sequence
  Description of Artificial Sequence: Chemically synthesized oligonucleotide
gcctgctcccttttggagg

SEQ ID NO: 3232 - DNA, 19 bp, Artificial Sequence
  Description of Artificial Sequence: Chemically synthesized oligonucleotide
cctccaaaagggagcaggc

SEQ ID NO: 3233 - DNA, 19 bp, Artificial Sequence
  Description of Artificial Sequence: Chemically synthesized oligonucleotide
cctgctcccttttggaggg

SEQ ID NO: 3234 - DNA, 19 bp, Artificial Sequence
  Description of Artificial Sequence: Chemically synthesized oligonucleotide
ccctccaaaagggagcagg

SEQ ID NO: 3235 - DNA, 19 bp, Artificial Sequence
  Description of Artificial Sequence: Chemically synthesized oligonucleotide
ctgctcccttttggagggg

SEQ ID NO: 3236 - DNA, 19 bp, Artificial Sequence
  Description of Artificial Sequence: Chemically synthesized oligonucleotide
cccctccaaaagggagcag

SEQ ID NO: 3237 - DNA, 19 bp, Artificial Sequence
  Description of Artificial Sequence: Chemically synthesized oligonucleotide
tgctcccttttggaggggc

SEQ ID NO: 3238 - DNA, 19 bp, Artificial Sequence
  Description of Artificial Sequence: Chemically synthesized oligonucleotide
gcccctccaaaagggagca

SEQ ID NO: 3239 - DNA, 19 bp, Artificial Sequence
  Description of Artificial Sequence: Chemically synthesized oligonucleotide
gctcccttttggaggggcg

SEQ ID NO: 3240 - DNA, 19 bp, Artificial Sequence
  Description of Artificial Sequence: Chemically synthesized oligonucleotide
cgcccctccaaaagggagc

SEQ ID NO: 3241 - DNA, 19 bp, Artificial Sequence
  Description of Artificial Sequence: Chemically synthesized oligonucleotide
ctcccttttggaggggcgt

SEQ ID NO: 3242 - DNA, 19 bp, Artificial Sequence
  Description of Artificial Sequence: Chemically synthesized oligonucleotide
acgcccctccaaaagggag

SEQ ID NO: 3243 - DNA, 19 bp, Artificial Sequence
  Description of Artificial Sequence: Chemically synthesized oligonucleotide
tcccttttggaggggcgtc

SEQ ID NO: 3244 - DNA, 19 bp, Artificial Sequence
  Description of Artificial Sequence: Chemically synthesized oligonucleotide
gacgcccctccaaaaggga

SEQ ID NO: 3245 - DNA, 19 bp, Artificial Sequence
  Description of Artificial Sequence: Chemically synthesized oligonucleotide
cccttttggaggggcgtcc

SEQ ID NO: 3246 - DNA, 19 bp, Artificial Sequence
  Description of Artificial Sequence: Chemically synthesized oligonucleotide
ggacgcccctccaaaaggg

SEQ ID NO: 3247 - DNA, 19 bp, Artificial Sequence
  Description of Artificial Sequence: Chemically synthesized oligonucleotide
ccttttggaggggcgtcct

SEQ ID NO: 3248 - DNA, 19 bp, Artificial Sequence
  Description of Artificial Sequence: Chemically synthesized oligonucleotide
aggacgcccctccaaaagg

SEQ ID NO: 3249 - DNA, 19 bp, Artificial Sequence
  Description of Artificial Sequence: Chemically synthesized oligonucleotide
cttttggaggggcgtcctg

SEQ ID NO: 3250 - DNA, 19 bp, Artificial Sequence
  Description of Artificial Sequence: Chemically synthesized oligonucleotide
caggacgcccctccaaaag

SEQ ID NO: 3251 - DNA, 19 bp, Artificial Sequence
  Description of Artificial Sequence: Chemically synthesized oligonucleotide
ttttggaggggcgtcctga

SEQ ID NO: 3252 - DNA, 19 bp, Artificial Sequence
  Description of Artificial Sequence: Chemically synthesized oligonucleotide
tcaggacgcccctccaaaa

SEQ ID NO: 3253 - DNA, 19 bp, Artificial Sequence
  Description of Artificial Sequence: Chemically synthesized oligonucleotide
tttggaggggcgtcctgag

SEQ ID NO: 3254 - DNA, 19 bp, Artificial Sequence
  Description of Artificial Sequence: Chemically synthesized oligonucleotide
ctcaggacgcccctccaaa

SEQ ID NO: 3255 - DNA, 19 bp, Artificial Sequence
  Description of Artificial Sequence: Chemically synthesized oligonucleotide
ttggaggggcgtcctgagc

SEQ ID NO: 3256 - DNA, 19 bp, Artificial Sequence
  Description of Artificial Sequence: Chemically synthesized oligonucleotide
gctcaggacgcccctccaa

SEQ ID NO: 3257 - DNA, 19 bp, Artificial Sequence
  Description of Artificial Sequence: Chemically synthesized oligonucleotide
tggaggggcgtcctgagca

SEQ ID NO: 3258 - DNA, 19 bp, Artificial Sequence
  Description of Artificial Sequence: Chemically synthesized oligonucleotide
tgctcaggacgcccctcca

SEQ ID NO: 3259 - DNA, 19 bp, Artificial Sequence
  Description of Artificial Sequence: Chemically synthesized oligonucleotide
ggaggggcgtcctgagcac

SEQ ID NO: 3260 - DNA, 19 bp, Artificial Sequence
  Description of Artificial Sequence: Chemically synthesized oligonucleotide
gtgctcaggacgcccctcc

SEQ ID NO: 3261 - DNA, 19 bp, Artificial Sequence
  Description of Artificial Sequence: Chemically synthesized oligonucleotide
gaggggcgtcctgagcacc

SEQ ID NO: 3262 - DNA, 19 bp, Artificial Sequence
  Description of Artificial Sequence: Chemically synthesized oligonucleotide
ggtgctcaggacgcccctc

SEQ ID NO: 3263 - DNA, 19 bp, Artificial Sequence
  Description of Artificial Sequence: Chemically synthesized oligonucleotide
aggggcgtcctgagcaccc

SEQ ID NO: 3264 - DNA, 19 bp, Artificial Sequence
  Description of Artificial Sequence: Chemically synthesized oligonucleotide
gggtgctcaggacgcccct

SEQ ID NO: 3265 - DNA, 19 bp, Artificial Sequence
  Description of Artificial Sequence: Chemically synthesized oligonucleotide
ggggcgtcctgagcacccc

SEQ ID NO: 3266 - DNA, 19 bp, Artificial Sequence
  Description of Artificial Sequence: Chemically synthesized oligonucleotide
ggggtgctcaggacgcccc

SEQ ID NO: 3267 - DNA, 19 bp, Artificial Sequence
  Description of Artificial Sequence: Chemically synthesized oligonucleotide
gggcgtcctgagcacccca

SEQ ID NO: 3268 - DNA, 19 bp, Artificial Sequence
  Description of Artificial Sequence: Chemically synthesized oligonucleotide
tggggtgctcaggacgccc

SEQ ID NO: 3269 - DNA, 19 bp, Artificial Sequence
  Description of Artificial Sequence: Chemically synthesized oligonucleotide
ggcgtcctgagcaccccag

SEQ ID NO: 3270 - DNA, 19 bp, Artificial Sequence
  Description of Artificial Sequence: Chemically synthesized oligonucleotide
ctggggtgctcaggacgcc

SEQ ID NO: 3271 - DNA, 19 bp, Artificial Sequence
  Description of Artificial Sequence: Chemically synthesized oligonucleotide
gcgtcctgagcaccccaga

SEQ ID NO: 3272 - DNA, 19 bp, Artificial Sequence
  Description of Artificial Sequence: Chemically synthesized oligonucleotide
tctggggtgctcaggacgc

SEQ ID NO: 3273 - DNA, 19 bp, Artificial Sequence
  Description of Artificial Sequence: Chemically synthesized oligonucleotide
cgtcctgagcaccccagac

SEQ ID NO: 3274 - DNA, 19 bp, Artificial Sequence
  Description of Artificial Sequence: Chemically synthesized oligonucleotide
gtctggggtgctcaggacg

SEQ ID NO: 3275 - DNA, 19 bp, Artificial Sequence
  Description of Artificial Sequence: Chemically synthesized oligonucleotide
gtcctgagcaccccagact

SEQ ID NO: 3276 - DNA, 19 bp, Artificial Sequence
  Description of Artificial Sequence: Chemically synthesized oligonucleotide
agtctggggtgctcaggac

SEQ ID NO: 3277 - DNA, 19 bp, Artificial Sequence
  Description of Artificial Sequence: Chemically synthesized oligonucleotide
tcctgagcaccccagactc

SEQ ID NO: 3278 - DNA, 19 bp, Artificial Sequence
  Description of Artificial Sequence: Chemically synthesized oligonucleotide
gagtctggggtgctcagga

SEQ ID NO: 3279 - DNA, 19 bp, Artificial Sequence
  Description of Artificial Sequence: Chemically synthesized oligonucleotide
cctgagcaccccagactcc

SEQ ID NO: 3280 - DNA, 19 bp, Artificial Sequence
  Description of Artificial Sequence: Chemically synthesized oligonucleotide
ggagtctggggtgctcagg

SEQ ID NO: 3281 - DNA, 19 bp, Artificial Sequence
  Description of Artificial Sequence: Chemically synthesized oligonucleotide
ctgagcaccccagactcct

SEQ ID NO: 3282 - DNA, 19 bp, Artificial Sequence
  Description of Artificial Sequence: Chemically synthesized oligonucleotide
aggagtctggggtgctcag

SEQ ID NO: 3283 - DNA, 19 bp, Artificial Sequence
  Description of Artificial Sequence: Chemically synthesized oligonucleotide
tgagcaccccagactcctg

SEQ ID NO: 3284 - DNA, 19 bp, Artificial Sequence
  Description of Artificial Sequence: Chemically synthesized oligonucleotide
caggagtctggggtgctca

SEQ ID NO: 3285 - DNA, 19 bp, Artificial Sequence
  Description of Artificial Sequence: Chemically synthesized oligonucleotide
gagcaccccagactcctgg

SEQ ID NO: 3286 - DNA, 19 bp, Artificial Sequence
  Description of Artificial Sequence: Chemically synthesized oligonucleotide
ccaggagtctggggtgctc

SEQ ID NO: 3287 - DNA, 19 bp, Artificial Sequence
  Description of Artificial Sequence: Chemically synthesized oligonucleotide
agcaccccagactcctggc

SEQ ID NO: 3288 - DNA, 19 bp, Artificial Sequence
  Description of Artificial Sequence: Chemically synthesized oligonucleotide
gccaggagtctggggtgct

SEQ ID NO: 3289 - DNA, 19 bp, Artificial Sequence
  Description of Artificial Sequence: Chemically synthesized oligonucleotide
gcaccccagactcctggct

SEQ ID NO: 3290 - DNA, 19 bp, Artificial Sequence
  Description of Artificial Sequence: Chemically synthesized oligonucleotide
agccaggagtctggggtgc

SEQ ID NO: 3291 - DNA, 19 bp, Artificial Sequence
  Description of Artificial Sequence: Chemically synthesized oligonucleotide
caccccagactcctggctt

SEQ ID NO: 3292 - DNA, 19 bp, Artificial Sequence
  Description of Artificial Sequence: Chemically synthesized oligonucleotide
aagccaggagtctggggtg

SEQ ID NO: 3293 - DNA, 19 bp, Artificial Sequence
  Description of Artificial Sequence: Chemically synthesized oligonucleotide
accccagactcctggcttc

SEQ ID NO: 3294 - DNA, 19 bp, Artificial Sequence
  Description of Artificial Sequence: Chemically synthesized oligonucleotide
gaagccaggagtctggggt

SEQ ID NO: 3295 - DNA, 19 bp, Artificial Sequence
  Description of Artificial Sequence: Chemically synthesized oligonucleotide
ccccagactcctggcttcc

SEQ ID NO: 3296 - DNA, 19 bp, Artificial Sequence
  Description of Artificial Sequence: Chemically synthesized oligonucleotide
ggaagccaggagtctgggg

SEQ ID NO: 3297 - DNA, 19 bp, Artificial Sequence
  Description of Artificial Sequence: Chemically synthesized oligonucleotide
cccagactcctggcttccc

SEQ ID NO: 3298 - DNA, 19 bp, Artificial Sequence
  Description of Artificial Sequence: Chemically synthesized oligonucleotide
gggaagccaggagtctggg

SEQ ID NO: 3299 - DNA, 19 bp, Artificial Sequence
  Description of Artificial Sequence: Chemically synthesized oligonucleotide
ccagactcctggcttcccc

SEQ ID NO: 3300 - DNA, 19 bp, Artificial Sequence
  Description of Artificial Sequence: Chemically synthesized oligonucleotide
ggggaagccaggagtctgg

SEQ ID NO: 3301 - DNA, 19 bp, Artificial Sequence
  Description of Artificial Sequence: Chemically synthesized oligonucleotide
cagactcctggcttccccc

SEQ ID NO: 3302 - DNA, 19 bp, Artificial Sequence
  Description of Artificial Sequence: Chemically synthesized oligonucleotide
gggggaagccaggagtctg

SEQ ID NO: 3303 - DNA, 19 bp, Artificial Sequence
  Description of Artificial Sequence: Chemically synthesized oligonucleotide
agactcctggcttccccct

SEQ ID NO: 3304 - DNA, 19 bp, Artificial Sequence
  Description of Artificial Sequence: Chemically synthesized oligonucleotide
agggggaagccaggagtct

SEQ ID NO: 3305 - DNA, 19 bp, Artificial Sequence
  Description of Artificial Sequence: Chemically synthesized oligonucleotide
gactcctggcttccccctg

SEQ ID NO: 3306 - DNA, 19 bp, Artificial Sequence
  Description of Artificial Sequence: Chemically synthesized oligonucleotide
cagggggaagccaggagtc

SEQ ID NO: 3307 - DNA, 19 bp, Artificial Sequence
  Description of Artificial Sequence: Chemically synthesized oligonucleotide
actcctggcttccccctgg

SEQ ID NO: 3308 - DNA, 19 bp, Artificial Sequence
  Description of Artificial Sequence: Chemically synthesized oligonucleotide
ccagggggaagccaggagt

SEQ ID NO: 3309 - DNA, 19 bp, Artificial Sequence
  Description of Artificial Sequence: Chemically synthesized oligonucleotide
ctcctggcttccccctggc

SEQ ID NO: 3310 - DNA, 19 bp, Artificial Sequence
  Description of Artificial Sequence: Chemically synthesized oligonucleotide
gccagggggaagccaggag

SEQ ID NO: 3311 - DNA, 19 bp, Artificial Sequence
  Description of Artificial Sequence: Chemically synthesized oligonucleotide
tcctggcttccccctggct

SEQ ID NO: 3312 - DNA, 19 bp, Artificial Sequence
  Description of Artificial Sequence: Chemically synthesized oligonucleotide
agccagggggaagccagga

SEQ ID NO: 3313 - DNA, 19 bp, Artificial Sequence
  Description of Artificial Sequence: Chemically synthesized oligonucleotide
cctggcttccccctggctt

SEQ ID NO: 3314 - DNA, 19 bp, Artificial Sequence
  Description of Artificial Sequence: Chemically synthesized oligonucleotide
aagccagggggaagccagg

SEQ ID NO: 3315 - DNA, 19 bp, Artificial Sequence
  Description of Artificial Sequence: Chemically synthesized oligonucleotide
ctggcttccccctggcttc

SEQ ID NO: 3316 - DNA, 19 bp, Artificial Sequence
  Description of Artificial Sequence: Chemically synthesized oligonucleotide
gaagccagggggaagccag

SEQ ID NO: 3317 - DNA, 19 bp, Artificial Sequence
  Description of Artificial Sequence: Chemically synthesized oligonucleotide
tggcttccccctggcttcc

SEQ ID NO: 3318 - DNA, 19 bp, Artificial Sequence
  Description of Artificial Sequence: Chemically synthesized oligonucleotide
ggaagccagggggaagcca

SEQ ID NO: 3319 - DNA, 19 bp, Artificial Sequence
  Description of Artificial Sequence: Chemically synthesized oligonucleotide
ggcttccccctggcttccc

SEQ ID NO: 3320 - DNA, 19 bp, Artificial Sequence
  Description of Artificial Sequence: Chemically synthesized oligonucleotide
gggaagccagggggaagcc

SEQ ID NO: 3321 - DNA, 19 bp, Artificial Sequence
  Description of Artificial Sequence: Chemically synthesized oligonucleotide
gcttccccctggcttcccc

SEQ ID NO: 3322 - DNA, 19 bp, Artificial Sequence
  Description of Artificial Sequence: Chemically synthesized oligonucleotide
ggggaagccagggggaagc

SEQ ID NO: 3323 - DNA, 19 bp, Artificial Sequence
  Description of Artificial Sequence: Chemically synthesized oligonucleotide
cttccccctggcttccccc

SEQ ID NO: 3324 - DNA, 19 bp, Artificial Sequence
  Description of Artificial Sequence: Chemically synthesized oligonucleotide
gggggaagccagggggaag

SEQ ID NO: 3325 - DNA, 19 bp, Artificial Sequence
  Description of Artificial Sequence: Chemically synthesized oligonucleotide
ttccccctggcttccccca

SEQ ID NO: 3326 - DNA, 19 bp, Artificial Sequence
  Description of Artificial Sequence: Chemically synthesized oligonucleotide
tgggggaagccagggggaa

SEQ ID NO: 3327 - DNA, 19 bp, Artificial Sequence
  Description of Artificial Sequence: Chemically synthesized oligonucleotide
tccccctggcttcccccag

SEQ ID NO: 3328 - DNA, 19 bp, Artificial Sequence
  Description of Artificial Sequence: Chemically synthesized oligonucleotide
ctgggggaagccaggggga

SEQ ID NO: 3329 - DNA, 19 bp, Artificial Sequence
  Description of Artificial Sequence: Chemically synthesized oligonucleotide
ccccctggcttcccccagg

SEQ ID NO: 3330 - DNA, 19 bp, Artificial Sequence
  Description of Artificial Sequence: Chemically synthesized oligonucleotide
cctgggggaagccaggggg

SEQ ID NO: 3331 - DNA, 19 bp, Artificial Sequence
  Description of Artificial Sequence: Chemically synthesized oligonucleotide
cccctggcttcccccaggg

SEQ ID NO: 3332 - DNA, 19 bp, Artificial Sequence
  Description of Artificial Sequence: Chemically synthesized oligonucleotide
ccctgggggaagccagggg

SEQ ID NO: 3333 - DNA, 19 bp, Artificial Sequence
  Description of Artificial Sequence: Chemically synthesized oligonucleotide
ccctggcttcccccagggc

SEQ ID NO: 3334 - DNA, 19 bp, Artificial Sequence
  Description of Artificial Sequence: Chemically synthesized oligonucleotide
gccctgggggaagccaggg

SEQ ID NO: 3335 - DNA, 19 bp, Artificial Sequence
  Description of Artificial Sequence: Chemically synthesized oligonucleotide
cctggcttcccccagggcc

SEQ ID NO: 3336 - DNA, 19 bp, Artificial Sequence
  Description of Artificial Sequence: Chemically synthesized oligonucleotide
ggccctgggggaagccagg

SEQ ID NO: 3337 - DNA, 19 bp, Artificial Sequence
  Description of Artificial Sequence: Chemically synthesized oligonucleotide
ctggcttcccccagggccc

SEQ ID NO: 3338 - DNA, 19 bp, Artificial Sequence
  Description of Artificial Sequence: Chemically synthesized oligonucleotide
gggccctgggggaagccag

SEQ ID NO: 3339 - DNA, 19 bp, Artificial Sequence
  Description of Artificial Sequence: Chemically synthesized oligonucleotide
tggcttcccccagggcccc

SEQ ID NO: 3340 - DNA, 19 bp, Artificial Sequence
  Description of Artificial Sequence: Chemically synthesized oligonucleotide
ggggccctgggggaagcca

SEQ ID NO: 3341 - DNA, 19 bp, Artificial Sequence
  Description of Artificial Sequence: Chemically synthesized oligonucleotide
ggcttcccccagggcccca

SEQ ID NO: 3342 - DNA, 19 bp, Artificial Sequence
  Description of Artificial Sequence: Chemically synthesized oligonucleotide
tggggccctgggggaagcc

SEQ ID NO: 3343 - DNA, 19 bp, Artificial Sequence
  Description of Artificial Sequence: Chemically synthesized oligonucleotide
gcttcccccagggccccaa

SEQ ID NO: 3344 - DNA, 19 bp, Artificial Sequence
  Description of Artificial Sequence: Chemically synthesized oligonucleotide
ttggggccctgggggaagc

SEQ ID NO: 3345 - DNA, 19 bp, Artificial Sequence
  Description of Artificial Sequence: Chemically synthesized oligonucleotide
cttcccccagggccccaag

SEQ ID NO: 3346 - DNA, 19 bp, Artificial Sequence
  Description of Artificial Sequence: Chemically synthesized oligonucleotide
cttggggccctgggggaag

SEQ ID NO: 3347 - DNA, 19 bp, Artificial Sequence
  Description of Artificial Sequence: Chemically synthesized oligonucleotide
ttcccccagggccccaagg

SEQ ID NO: 3348 - DNA, 19 bp, Artificial Sequence
  Description of Artificial Sequence: Chemically synthesized oligonucleotide
ccttggggccctgggggaa

SEQ ID NO: 3349 - DNA, 19 bp, Artificial Sequence
  Description of Artificial Sequence: Chemically synthesized oligonucleotide
tcccccagggccccaagga

SEQ ID NO: 3350 - DNA, 19 bp, Artificial Sequence
  Description of Artificial Sequence: Chemically synthesized oligonucleotide
tccttggggccctggggga

SEQ ID NO: 3351 - DNA, 19 bp, Artificial Sequence
  Description of Artificial Sequence: Chemically synthesized oligonucleotide
cccccagggccccaaggac

SEQ ID NO: 3352 - DNA, 19 bp, Artificial Sequence
  Description of Artificial Sequence: Chemically synthesized oligonucleotide
gtccttggggccctggggg

SEQ ID NO: 3353 - DNA, 19 bp, Artificial Sequence
  Description of Artificial Sequence: Chemically synthesized oligonucleotide
ccccagggccccaaggaca

SEQ ID NO: 3354 - DNA, 19 bp, Artificial Sequence
  Description of Artificial Sequence: Chemically synthesized oligonucleotide
tgtccttggggccctgggg

SEQ ID NO: 3355 - DNA, 19 bp, Artificial Sequence
  Description of Artificial Sequence: Chemically synthesized oligonucleotide
cccagggccccaaggacat

SEQ ID NO: 3356 - DNA, 19 bp, Artificial Sequence
  Description of Artificial Sequence: Chemically synthesized oligonucleotide
atgtccttggggccctggg

SEQ ID NO: 3357 - DNA, 19 bp, Artificial Sequence
  Description of Artificial Sequence: Chemically synthesized oligonucleotide
ccagggccccaaggacatg

SEQ ID NO: 3358 - DNA, 19 bp, Artificial Sequence
  Description of Artificial Sequence: Chemically synthesized oligonucleotide
catgtccttggggccctgg

SEQ ID NO: 3359 - DNA, 19 bp, Artificial Sequence
  Description of Artificial Sequence: Chemically synthesized oligonucleotide
cagggccccaaggacatgc

SEQ ID NO: 3360 - DNA, 19 bp, Artificial Sequence
  Description of Artificial Sequence: Chemically synthesized oligonucleotide
gcatgtccttggggccctg

SEQ ID NO: 3361 - DNA, 19 bp, Artificial Sequence
  Description of Artificial Sequence: Chemically synthesized oligonucleotide
agggccccaaggacatgct

SEQ ID NO: 3362 - DNA, 19 bp, Artificial Sequence
  Description of Artificial Sequence: Chemically synthesized oligonucleotide
agcatgtccttggggccct

SEQ ID NO: 3363 - DNA, 19 bp, Artificial Sequence
  Description of Artificial Sequence: Chemically synthesized oligonucleotide
gggccccaaggacatgctc

SEQ ID NO: 3364 - DNA, 19 bp, Artificial Sequence
  Description of Artificial Sequence: Chemically synthesized oligonucleotide
gagcatgtccttggggccc

SEQ ID NO: 3365 - DNA, 19 bp, Artificial Sequence
  Description of Artificial Sequence: Chemically synthesized oligonucleotide
ggccccaaggacatgctcc

SEQ ID NO: 3366 - DNA, 19 bp, Artificial Sequence
  Description of Artificial Sequence: Chemically synthesized oligonucleotide
ggagcatgtccttggggcc

SEQ ID NO: 3367 - DNA, 19 bp, Artificial Sequence
  Description of Artificial Sequence: Chemically synthesized oligonucleotide
gccccaaggacatgctccc

SEQ ID NO: 3368 - DNA, 19 bp, Artificial Sequence
  Description of Artificial Sequence: Chemically synthesized oligonucleotide
gggagcatgtccttggggc

SEQ ID NO: 3369 - DNA, 19 bp, Artificial Sequence
  Description of Artificial Sequence: Chemically synthesized oligonucleotide
ccccaaggacatgctccca

SEQ ID NO: 3370 - DNA, 19 bp, Artificial Sequence
  Description of Artificial Sequence: Chemically synthesized oligonucleotide
tgggagcatgtccttgggg

SEQ ID NO: 3371 - DNA, 19 bp, Artificial Sequence
  Description of Artificial Sequence: Chemically synthesized oligonucleotide
cccaaggacatgctcccac

SEQ ID NO: 3372 - DNA, 19 bp, Artificial Sequence
  Description of Artificial Sequence: Chemically synthesized oligonucleotide
gtgggagcatgtccttggg

SEQ ID NO: 3373 - DNA, 19 bp, Artificial Sequence
  Description of Artificial Sequence: Chemically synthesized oligonucleotide
ccaaggacatgctcccact

SEQ ID NO: 3374 - DNA, 19 bp, Artificial Sequence
  Description of Artificial Sequence: Chemically synthesized oligonucleotide
agtgggagcatgtccttgg

SEQ ID NO: 3375 - DNA, 19 bp, Artificial Sequence
  Description of Artificial Sequence: Chemically synthesized oligonucleotide
caaggacatgctcccactt

SEQ ID NO: 3376 - DNA, 19 bp, Artificial Sequence
  Description of Artificial Sequence: Chemically synthesized oligonucleotide
aagtgggagcatgtccttg

SEQ ID NO: 3377 - DNA, 19 bp, Artificial Sequence
  Description of Artificial Sequence: Chemically synthesized oligonucleotide
aaggacatgctcccacttg

SEQ ID NO: 3378 - DNA, 19 bp, Artificial Sequence
  Description of Artificial Sequence: Chemically synthesized oligonucleotide
caagtgggagcatgtcctt

SEQ ID NO: 3379 - DNA, 19 bp, Artificial Sequence
  Description of Artificial Sequence: Chemically synthesized oligonucleotide
aggacatgctcccacttgt

SEQ ID NO: 3380 - DNA, 19 bp, Artificial Sequence
  Description of Artificial Sequence: Chemically synthesized oligonucleotide
acaagtgggagcatgtcct

SEQ ID NO: 3381 - DNA, 19 bp, Artificial Sequence
  Description of Artificial Sequence: Chemically synthesized oligonucleotide
ggacatgctcccacttgtg

SEQ ID NO: 3382 - DNA, 19 bp, Artificial Sequence
  Description of Artificial Sequence: Chemically synthesized oligonucleotide
cacaagtgggagcatgtcc

SEQ ID NO: 3383 - DNA, 19 bp, Artificial Sequence
  Description of Artificial Sequence: Chemically synthesized oligonucleotide
gacatgctcccacttgtgg

SEQ ID NO: 3384 - DNA, 19 bp, Artificial Sequence
  Description of Artificial Sequence: Chemically synthesized oligonucleotide
ccacaagtgggagcatgtc

SEQ ID NO: 3385 - DNA, 19 bp, Artificial Sequence
  Description of Artificial Sequence: Chemically synthesized oligonucleotide
acatgctcccacttgtgga

SEQ ID NO: 3386 - DNA, 19 bp, Artificial Sequence
  Description of Artificial Sequence: Chemically synthesized oligonucleotide
tccacaagtgggagcatgt

SEQ ID NO: 3387 - DNA, 19 bp, Artificial Sequence
  Description of Artificial Sequence: Chemically synthesized oligonucleotide
catgctcccacttgtggag

SEQ ID NO: 3388 - DNA, 19 bp, Artificial Sequence
  Description of Artificial Sequence: Chemically synthesized oligonucleotide
ctccacaagtgggagcatg

SEQ ID NO: 3389 - DNA, 19 bp, Artificial Sequence
  Description of Artificial Sequence: Chemically synthesized oligonucleotide
atgctcccacttgtggagg

SEQ ID NO: 3390 - DNA, 19 bp, Artificial Sequence
  Description of Artificial Sequence: Chemically synthesized oligonucleotide
cctccacaagtgggagcat

SEQ ID NO: 3391 - DNA, 19 bp, Artificial Sequence
  Description of Artificial Sequence: Chemically synthesized oligonucleotide
tgctcccacttgtggaggg

SEQ ID NO: 3392 - DNA, 19 bp, Artificial Sequence
  Description of Artificial Sequence: Chemically synthesized oligonucleotide
ccctccacaagtgggagca

SEQ ID NO: 3393 - DNA, 19 bp, Artificial Sequence
  Description of Artificial Sequence: Chemically synthesized oligonucleotide
gctcccacttgtggagggc

SEQ ID NO: 3394 - DNA, 19 bp, Artificial Sequence
  Description of Artificial Sequence: Chemically synthesized oligonucleotide
gccctccacaagtgggagc

SEQ ID NO: 3395 - DNA, 19 bp, Artificial Sequence
  Description of Artificial Sequence: Chemically synthesized oligonucleotide
ctcccacttgtggagggcg

SEQ ID NO: 3396 - DNA, 19 bp, Artificial Sequence
  Description of Artificial Sequence: Chemically synthesized oligonucleotide
cgccctccacaagtgggag

SEQ ID NO: 3397 - DNA, 19 bp, Artificial Sequence
  Description of Artificial Sequence: Chemically synthesized oligonucleotide
tcccacttgtggagggcga

SEQ ID NO: 3398 - DNA, 19 bp, Artificial Sequence
  Description of Artificial Sequence: Chemically synthesized oligonucleotide
tcgccctccacaagtggga

SEQ ID NO: 3399 - DNA, 19 bp, Artificial Sequence
  Description of Artificial Sequence: Chemically synthesized oligonucleotide
cccacttgtggagggcgag

SEQ ID NO: 3400 - DNA, 19 bp, Artificial Sequence
  Description of Artificial Sequence: Chemically synthesized oligonucleotide
ctcgccctccacaagtggg

SEQ ID NO: 3401 - DNA, 19 bp, Artificial Sequence
  Description of Artificial Sequence: Chemically synthesized oligonucleotide
ccacttgtggagggcgagg

SEQ ID NO: 3402 - DNA, 19 bp, Artificial Sequence
  Description of Artificial Sequence: Chemically synthesized oligonucleotide
cctcgccctccacaagtgg

SEQ ID NO: 3403 - DNA, 19 bp, Artificial Sequence
  Description of Artificial Sequence: Chemically synthesized oligonucleotide
cacttgtggagggcgaggg

SEQ ID NO: 3404 - DNA, 19 bp, Artificial Sequence
  Description of Artificial Sequence: Chemically synthesized oligonucleotide
ccctcgccctccacaagtg

SEQ ID NO: 3405 - DNA, 19 bp, Artificial Sequence
  Description of Artificial Sequence: Chemically synthesized oligonucleotide
acttgtggagggcgagggc

SEQ ID NO: 3406 - DNA, 19 bp, Artificial Sequence
  Description of Artificial Sequence: Chemically synthesized oligonucleotide
gccctcgccctccacaagt

SEQ ID NO: 3407 - DNA, 19 bp, Artificial Sequence
  Description of Artificial Sequence: Chemically synthesized oligonucleotide
cttgtggagggcgagggcc

SEQ ID NO: 3408 - DNA, 19 bp, Artificial Sequence
  Description of Artificial Sequence: Chemically synthesized oligonucleotide
ggccctcgccctccacaag

SEQ ID NO: 3409 - DNA, 19 bp, Artificial Sequence
  Description of Artificial Sequence: Chemically synthesized oligonucleotide
ttgtggagggcgagggccc

SEQ ID NO: 3410 - DNA, 19 bp, Artificial Sequence
  Description of Artificial Sequence: Chemically synthesized oligonucleotide
gggccctcgccctccacaa

SEQ ID NO: 3411 - DNA, 19 bp, Artificial Sequence
  Description of Artificial Sequence: Chemically synthesized oligonucleotide
tgtggagggcgagggcccc

SEQ ID NO: 3412 - DNA, 19 bp, Artificial Sequence
  Description of Artificial Sequence: Chemically synthesized oligonucleotide
ggggccctcgccctccaca

SEQ ID NO: 3413 - DNA, 19 bp, Artificial Sequence
  Description of Artificial Sequence: Chemically synthesized oligonucleotide
gtggagggcgagggccccc

SEQ ID NO: 3414 - DNA, 19 bp, Artificial Sequence
  Description of Artificial Sequence: Chemically synthesized oligonucleotide
gggggccctcgccctccac

SEQ ID NO: 3415 - DNA, 19 bp, Artificial Sequence
  Description of Artificial Sequence: Chemically synthesized oligonucleotide
tggagggcgagggccccca

SEQ ID NO: 3416 - DNA, 19 bp, Artificial Sequence
  Description of Artificial Sequence: Chemically synthesized oligonucleotide
tgggggccctcgccctcca

SEQ ID NO: 3417 - DNA, 19 bp, Artificial Sequence
  Description of Artificial Sequence: Chemically synthesized oligonucleotide
ggagggcgagggcccccag

SEQ ID NO: 3418 - DNA, 19 bp, Artificial Sequence
  Description of Artificial Sequence: Chemically synthesized oligonucleotide
ctgggggccctcgccctcc

SEQ ID NO: 3419 - DNA, 19 bp, Artificial Sequence
  Description of Artificial Sequence: Chemically synthesized oligonucleotide
gagggcgagggcccccaga

SEQ ID NO: 3420 - DNA, 19 bp, Artificial Sequence
  Description of Artificial Sequence: Chemically synthesized oligonucleotide
tctgggggccctcgccctc

SEQ ID NO: 3421 - DNA, 19 bp, Artificial Sequence
  Description of Artificial Sequence: Chemically synthesized oligonucleotide
agggcgagggcccccagaa

SEQ ID NO: 3422 - DNA, 19 bp, Artificial Sequence
  Description of Artificial Sequence: Chemically synthesized oligonucleotide
ttctgggggccctcgccct

SEQ ID NO: 3423 - DNA, 19 bp, Artificial Sequence
  Description of Artificial Sequence: Chemically synthesized oligonucleotide
gggcgagggcccccagaat

SEQ ID NO: 3424 - DNA, 19 bp, Artificial Sequence
  Description of Artificial Sequence: Chemically synthesized oligonucleotide
attctgggggccctcgccc

SEQ ID NO: 3425 - DNA, 19 bp, Artificial Sequence
  Description of Artificial Sequence: Chemically synthesized oligonucleotide
ggcgagggcccccagaatg

SEQ ID NO: 3426 - DNA, 19 bp, Artificial Sequence
  Description of Artificial Sequence: Chemically synthesized oligonucleotide
cattctgggggccctcgcc

SEQ ID NO: 3427 - DNA, 19 bp, Artificial Sequence
  Description of Artificial Sequence: Chemically synthesized oligonucleotide
gcgagggcccccagaatgg

SEQ ID NO: 3428 - DNA, 19 bp, Artificial Sequence
  Description of Artificial Sequence: Chemically synthesized oligonucleotide
ccattctgggggccctcgc

SEQ ID NO: 3429 - DNA, 19 bp, Artificial Sequence
  Description of Artificial Sequence: Chemically synthesized oligonucleotide
cgagggcccccagaatggg

SEQ ID NO: 3430 - DNA, 19 bp, Artificial Sequence
  Description of Artificial Sequence: Chemically synthesized oligonucleotide
cccattctgggggccctcg

SEQ ID NO: 3431 - DNA, 19 bp, Artificial Sequence
  Description of Artificial Sequence: Chemically synthesized oligonucleotide
gagggcccccagaatgggg

SEQ ID NO: 3432 - DNA, 19 bp, Artificial Sequence
  Description of Artificial Sequence: Chemically synthesized oligonucleotide
ccccattctgggggccctc

SEQ ID NO: 3433 - DNA, 19 bp, Artificial Sequence
  Description of Artificial Sequence: Chemically synthesized oligonucleotide
agggcccccagaatgggga

SEQ ID NO: 3434 - DNA, 19 bp, Artificial Sequence
  Description of Artificial Sequence: Chemically synthesized oligonucleotide
tccccattctgggggccct

SEQ ID NO: 3435 - DNA, 19 bp, Artificial Sequence
  Description of Artificial Sequence: Chemically synthesized oligonucleotide
gggcccccagaatggggag

SEQ ID NO: 3436 - DNA, 19 bp, Artificial Sequence
  Description of Artificial Sequence: Chemically synthesized oligonucleotide
ctccccattctgggggccc

SEQ ID NO: 3437 - DNA, 19 bp, Artificial Sequence
  Description of Artificial Sequence: Chemically synthesized oligonucleotide
ggcccccagaatggggaga

SEQ ID NO: 3438 - DNA, 19 bp, Artificial Sequence
  Description of Artificial Sequence: Chemically synthesized oligonucleotide
tctccccattctgggggcc

SEQ ID NO: 3439 - DNA, 19 bp, Artificial Sequence
  Description of Artificial Sequence: Chemically synthesized oligonucleotide
gcccccagaatggggagag

SEQ ID NO: 3440 - DNA, 19 bp, Artificial Sequence
  Description of Artificial Sequence: Chemically synthesized oligonucleotide
ctctccccattctgggggc

SEQ ID NO: 3441 - DNA, 19 bp, Artificial Sequence
  Description of Artificial Sequence: Chemically synthesized oligonucleotide
cccccagaatggggagagg

SEQ ID NO: 3442 - DNA, 19 bp, Artificial Sequence
  Description of Artificial Sequence: Chemically synthesized oligonucleotide
cctctccccattctggggg

SEQ ID NO: 3443 - DNA, 19 bp, Artificial Sequence
  Description of Artificial Sequence: Chemically synthesized oligonucleotide
ccccagaatggggagagga

SEQ ID NO: 3444 - DNA, 19 bp, Artificial Sequence
  Description of Artificial Sequence: Chemically synthesized oligonucleotide
tcctctccccattctgggg

SEQ ID NO: 3445 - DNA, 19 bp, Artificial Sequence
  Description of Artificial Sequence: Chemically synthesized oligonucleotide
cccagaatggggagaggaa

SEQ ID NO: 3446 - DNA, 19 bp, Artificial Sequence
  Description of Artificial Sequence: Chemically synthesized oligonucleotide
ttcctctccccattctggg

SEQ ID NO: 3447 - DNA, 19 bp, Artificial Sequence
  Description of Artificial Sequence: Chemically synthesized oligonucleotide
ccagaatggggagaggaag

SEQ ID NO: 3448 - DNA, 19 bp, Artificial Sequence
  Description of Artificial Sequence: Chemically synthesized oligonucleotide
cttcctctccccattctgg

SEQ ID NO: 3449 - DNA, 19 bp, Artificial Sequence
  Description of Artificial Sequence: Chemically synthesized oligonucleotide
cagaatggggagaggaagg

SEQ ID NO: 3450 - DNA, 19 bp, Artificial Sequence
  Description of Artificial Sequence: Chemically synthesized oligonucleotide
ccttcctctccccattctg

SEQ ID NO: 3451 - DNA, 19 bp, Artificial Sequence
  Description of Artificial Sequence: Chemically synthesized oligonucleotide
agaatggggagaggaaggt

SEQ ID NO: 3452 - DNA, 19 bp, Artificial Sequence
  Description of Artificial Sequence: Chemically synthesized oligonucleotide
accttcctctccccattct

SEQ ID NO: 3453 - DNA, 19 bp, Artificial Sequence
  Description of Artificial Sequence: Chemically synthesized oligonucleotide
gaatggggagaggaaggtc

SEQ ID NO: 3454 - DNA, 19 bp, Artificial Sequence
  Description of Artificial Sequence: Chemically synthesized oligonucleotide
gaccttcctctccccattc

SEQ ID NO: 3455 - DNA, 19 bp, Artificial Sequence
  Description of Artificial Sequence: Chemically synthesized oligonucleotide
aatggggagaggaaggtca

SEQ ID NO: 3456 - DNA, 19 bp, Artificial Sequence
  Description of Artificial Sequence: Chemically synthesized oligonucleotide
tgaccttcctctccccatt

SEQ ID NO: 3457 - DNA, 19 bp, Artificial Sequence
  Description of Artificial Sequence: Chemically synthesized oligonucleotide
atggggagaggaaggtcaa

SEQ ID NO: 3458 - DNA, 19 bp, Artificial Sequence
  Description of Artificial Sequence: Chemically synthesized oligonucleotide
ttgaccttcctctccccat

SEQ ID NO: 3459 - DNA, 19 bp, Artificial Sequence
  Description of Artificial Sequence: Chemically synthesized oligonucleotide
tggggagaggaaggtcaac

SEQ ID NO: 3460 - DNA, 19 bp, Artificial Sequence
  Description of Artificial Sequence: Chemically synthesized oligonucleotide
gttgaccttcctctcccca

SEQ ID NO: 3461 - DNA, 19 bp, Artificial Sequence
  Description of Artificial Sequence: Chemically synthesized oligonucleotide
ggggagaggaaggtcaact

SEQ ID NO: 3462 - DNA, 19 bp, Artificial Sequence
  Description of Artificial Sequence: Chemically synthesized oligonucleotide
agttgaccttcctctcccc

SEQ ID NO: 3463 - DNA, 19 bp, Artificial Sequence
  Description of Artificial Sequence: Chemically synthesized oligonucleotide
gggagaggaaggtcaactg

SEQ ID NO: 3464 - DNA, 19 bp, Artificial Sequence
  Description of Artificial Sequence: Chemically synthesized oligonucleotide
cagttgaccttcctctccc

SEQ ID NO: 3465 - DNA, 19 bp, Artificial Sequence
  Description of Artificial Sequence: Chemically synthesized oligonucleotide
ggagaggaaggtcaactgg

SEQ ID NO: 3466 - DNA, 19 bp, Artificial Sequence
  Description of Artificial Sequence: Chemically synthesized oligonucleotide
ccagttgaccttcctctcc

SEQ ID NO: 3467 - DNA, 19 bp, Artificial Sequence
  Description of Artificial Sequence: Chemically synthesized oligonucleotide
gagaggaaggtcaactggc

SEQ ID NO: 3468 - DNA, 19 bp, Artificial Sequence
  Description of Artificial Sequence: Chemically synthesized oligonucleotide
gccagttgaccttcctctc

SEQ ID NO: 3469 - DNA, 19 bp, Artificial Sequence
  Description of Artificial Sequence: Chemically synthesized oligonucleotide
agaggaaggtcaactggct

SEQ ID NO: 3470 - DNA, 19 bp, Artificial Sequence
  Description of Artificial Sequence: Chemically synthesized oligonucleotide
agccagttgaccttcctct

SEQ ID NO: 3471 - DNA, 19 bp, Artificial Sequence
  Description of Artificial Sequence: Chemically synthesized oligonucleotide
gaggaaggtcaactggctg

SEQ ID NO: 3472 - DNA, 19 bp, Artificial Sequence
  Description of Artificial Sequence: Chemically synthesized oligonucleotide
cagccagttgaccttcctc

SEQ ID NO: 3473 - DNA, 19 bp, Artificial Sequence
  Description of Artificial Sequence: Chemically synthesized oligonucleotide
aggaaggtcaactggctgg

SEQ ID NO: 3474 - DNA, 19 bp, Artificial Sequence
  Description of Artificial Sequence: Chemically synthesized oligonucleotide
ccagccagttgaccttcct

SEQ ID NO: 3475 - DNA, 19 bp, Artificial Sequence
  Description of Artificial Sequence: Chemically synthesized oligonucleotide
ggaaggtcaactggctggg

SEQ ID NO: 3476 - DNA, 19 bp, Artificial Sequence
  Description of Artificial Sequence: Chemically synthesized oligonucleotide
cccagccagttgaccttcc

SEQ ID NO: 3477 - DNA, 19 bp, Artificial Sequence
  Description of Artificial Sequence: Chemically synthesized oligonucleotide
gaaggtcaactggctgggc

SEQ ID NO: 3478 - DNA, 19 bp, Artificial Sequence
  Description of Artificial Sequence: Chemically synthesized oligonucleotide
gcccagccagttgaccttc

SEQ ID NO: 3479 - DNA, 19 bp, Artificial Sequence
  Description of Artificial Sequence: Chemically synthesized oligonucleotide
aaggtcaactggctgggca

SEQ ID NO: 3480 - DNA, 19 bp, Artificial Sequence
  Description of Artificial Sequence: Chemically synthesized oligonucleotide
tgcccagccagttgacctt

SEQ ID NO: 3481 - DNA, 19 bp, Artificial Sequence
  Description of Artificial Sequence: Chemically synthesized oligonucleotide
aggtcaactggctgggcag

SEQ ID NO: 3482 - DNA, 19 bp, Artificial Sequence
  Description of Artificial Sequence: Chemically synthesized oligonucleotide
ctgcccagccagttgacct

SEQ ID NO: 3483 - DNA, 19 bp, Artificial Sequence
  Description of Artificial Sequence: Chemically synthesized oligonucleotide
ggtcaactggctgggcagc

SEQ ID NO: 3484 - DNA, 19 bp, Artificial Sequence
  Description of Artificial Sequence: Chemically synthesized oligonucleotide
gctgcccagccagttgacc

SEQ ID NO: 3485 - DNA, 19 bp, Artificial Sequence
  Description of Artificial Sequence: Chemically synthesized oligonucleotide
gtcaactggctgggcagca

SEQ ID NO: 3486 - DNA, 19 bp, Artificial Sequence
  Description of Artificial Sequence: Chemically synthesized oligonucleotide
tgctgcccagccagttgac

SEQ ID NO: 3487 - DNA, 19 bp, Artificial Sequence
  Description of Artificial Sequence: Chemically synthesized oligonucleotide
tcaactggctgggcagcaa

SEQ ID NO: 3488 - DNA, 19 bp, Artificial Sequence
  Description of Artificial Sequence: Chemically synthesized oligonucleotide
ttgctgcccagccagttga

SEQ ID NO: 3489 - DNA, 19 bp, Artificial Sequence
  Description of Artificial Sequence: Chemically synthesized oligonucleotide
caactggctgggcagcaaa

SEQ ID NO: 3490 - DNA, 19 bp, Artificial Sequence
  Description of Artificial Sequence: Chemically synthesized oligonucleotide
tttgctgcccagccagttg

SEQ ID NO: 3491 - DNA, 19 bp, Artificial Sequence
  Description of Artificial Sequence: Chemically synthesized oligonucleotide
aactggctgggcagcaaag

SEQ ID NO: 3492 - DNA, 19 bp, Artificial Sequence
  Description of Artificial Sequence: Chemically synthesized oligonucleotide
ctttgctgcccagccagtt

SEQ ID NO: 3493 - DNA, 19 bp, Artificial Sequence
  Description of Artificial Sequence: Chemically synthesized oligonucleotide
actggctgggcagcaaaga

SEQ ID NO: 3494 - DNA, 19 bp, Artificial Sequence
  Description of Artificial Sequence: Chemically synthesized oligonucleotide
tctttgctgcccagccagt

SEQ ID NO: 3495 - DNA, 19 bp, Artificial Sequence
  Description of Artificial Sequence: Chemically synthesized oligonucleotide
ctggctgggcagcaaagag

SEQ ID NO: 3496 - DNA, 19 bp, Artificial Sequence
  Description of Artificial Sequence: Chemically synthesized oligonucleotide
ctctttgctgcccagccag

SEQ ID NO: 3497 - DNA, 19 bp, Artificial Sequence
  Description of Artificial Sequence: Chemically synthesized oligonucleotide
tggctgggcagcaaagagg

SEQ ID NO: 3498 - DNA, 19 bp, Artificial Sequence
  Description of Artificial Sequence: Chemically synthesized oligonucleotide
cctctttgctgcccagcca

SEQ ID NO: 3499 - DNA, 19 bp, Artificial Sequence
  Description of Artificial Sequence: Chemically synthesized oligonucleotide
ggctgggcagcaaagaggg

SEQ ID NO: 3500 - DNA, 19 bp, Artificial Sequence
  Description of Artificial Sequence: Chemically synthesized oligonucleotide
ccctctttgctgcccagcc

SEQ ID NO: 3501 - DNA, 19 bp, Artificial Sequence
  Description of Artificial Sequence: Chemically synthesized oligonucleotide
gctgggcagcaaagaggga

SEQ ID NO: 3502 - DNA, 19 bp, Artificial Sequence
  Description of Artificial Sequence: Chemically synthesized oligonucleotide
tccctctttgctgcccagc

SEQ ID NO: 3503 - DNA, 19 bp, Artificial Sequence
  Description of Artificial Sequence: Chemically synthesized oligonucleotide
ctgggcagcaaagagggac

SEQ ID NO: 3504 - DNA, 19 bp, Artificial Sequence
  Description of Artificial Sequence: Chemically synthesized oligonucleotide
gtccctctttgctgcccag

SEQ ID NO: 3505 - DNA, 19 bp, Artificial Sequence
  Description of Artificial Sequence: Chemically synthesized oligonucleotide
tgggcagcaaagagggact

SEQ ID NO: 3506 - DNA, 19 bp, Artificial Sequence
  Description of Artificial Sequence: Chemically synthesized oligonucleotide
agtccctctttgctgccca

SEQ ID NO: 3507 - DNA, 19 bp, Artificial Sequence
  Description of Artificial Sequence: Chemically synthesized oligonucleotide
gggcagcaaagagggactg

SEQ ID NO: 3508 - DNA, 19 bp, Artificial Sequence
  Description of Artificial Sequence: Chemically synthesized oligonucleotide
cagtccctctttgctgccc

SEQ ID NO: 3509 - DNA, 19 bp, Artificial Sequence
  Description of Artificial Sequence: Chemically synthesized oligonucleotide
ggcagcaaagagggactgc

SEQ ID NO: 3510 - DNA, 19 bp, Artificial Sequence
  Description of Artificial Sequence: Chemically synthesized oligonucleotide
gcagtccctctttgctgcc

SEQ ID NO: 3511 - DNA, 19 bp, Artificial Sequence
  Description of Artificial Sequence: Chemically synthesized oligonucleotide
gcagcaaagagggactgcg

SEQ ID NO: 3512 - DNA, 19 bp, Artificial Sequence
  Description of Artificial Sequence: Chemically synthesized oligonucleotide
cgcagtccctctttgctgc

SEQ ID NO: 3513 - DNA, 19 bp, Artificial Sequence
  Description of Artificial Sequence: Chemically synthesized oligonucleotide
cagcaaagagggactgcgc

SEQ ID NO: 3514 - DNA, 19 bp, Artificial Sequence
  Description of Artificial Sequence: Chemically synthesized oligonucleotide
gcgcagtccctctttgctg

SEQ ID NO: 3515 - DNA, 19 bp, Artificial Sequence
  Description of Artificial Sequence: Chemically synthesized oligonucleotide
agcaaagagggactgcgct

SEQ ID NO: 3516 - DNA, 19 bp, Artificial Sequence
  Description of Artificial Sequence: Chemically synthesized oligonucleotide
agcgcagtccctctttgct

SEQ ID NO: 3517 - DNA, 19 bp, Artificial Sequence
  Description of Artificial Sequence: Chemically synthesized oligonucleotide
gcaaagagggactgcgctg

SEQ ID NO: 3518 - DNA, 19 bp, Artificial Sequence
  Description of Artificial Sequence: Chemically synthesized oligonucleotide
cagcgcagtccctctttgc

SEQ ID NO: 3519 - DNA, 19 bp, Artificial Sequence
  Description of Artificial Sequence: Chemically synthesized oligonucleotide
caaagagggactgcgctgg

SEQ ID NO: 3520 - DNA, 19 bp, Artificial Sequence
  Description of Artificial Sequence: Chemically synthesized oligonucleotide
ccagcgcagtccctctttg

SEQ ID NO: 3521 - DNA, 19 bp, Artificial Sequence
  Description of Artificial Sequence: Chemically synthesized oligonucleotide
aaagagggactgcgctgga

SEQ ID NO: 3522 - DNA, 19 bp, Artificial Sequence
  Description of Artificial Sequence: Chemically synthesized oligonucleotide
tccagcgcagtccctcttt

SEQ ID NO: 3523 - DNA, 19 bp, Artificial Sequence
  Description of Artificial Sequence: Chemically synthesized oligonucleotide
aagagggactgcgctggaa

SEQ ID NO: 3524 - DNA, 19 bp, Artificial Sequence
  Description of Artificial Sequence: Chemically synthesized oligonucleotide
ttccagcgcagtccctctt

SEQ ID NO: 3525 - DNA, 19 bp, Artificial Sequence
  Description of Artificial Sequence: Chemically synthesized oligonucleotide
agagggactgcgctggaag

SEQ ID NO: 3526 - DNA, 19 bp, Artificial Sequence
  Description of Artificial Sequence: Chemically synthesized oligonucleotide
cttccagcgcagtccctct

SEQ ID NO: 3527 - DNA, 19 bp, Artificial Sequence
  Description of Artificial Sequence: Chemically synthesized oligonucleotide
gagggactgcgctggaagg

SEQ ID NO: 3528 - DNA, 19 bp, Artificial Sequence
  Description of Artificial Sequence: Chemically synthesized oligonucleotide
ccttccagcgcagtccctc

SEQ ID NO: 3529 - DNA, 19 bp, Artificial Sequence
  Description of Artificial Sequence: Chemically synthesized oligonucleotide
agggactgcgctggaagga

SEQ ID NO: 3530 - DNA, 19 bp, Artificial Sequence
  Description of Artificial Sequence: Chemically synthesized oligonucleotide
tccttccagcgcagtccct

SEQ ID NO: 3531 - DNA, 19 bp, Artificial Sequence
  Description of Artificial Sequence: Chemically synthesized oligonucleotide
gggactgcgctggaaggag

SEQ ID NO: 3532 - DNA, 19 bp, Artificial Sequence
  Description of Artificial Sequence: Chemically synthesized oligonucleotide
ctccttccagcgcagtccc

SEQ ID NO: 3533 - DNA, 19 bp, Artificial Sequence
  Description of Artificial Sequence: Chemically synthesized oligonucleotide
ggactgcgctggaaggagg

SEQ ID NO: 3534 - DNA, 19 bp, Artificial Sequence
  Description of Artificial Sequence: Chemically synthesized oligonucleotide
cctccttccagcgcagtcc

SEQ ID NO: 3535 - DNA, 19 bp, Artificial Sequence
  Description of Artificial Sequence: Chemically synthesized oligonucleotide
gactgcgctggaaggaggc

SEQ ID NO: 3536 - DNA, 19 bp, Artificial Sequence
  Description of Artificial Sequence: Chemically synthesized oligonucleotide
gcctccttccagcgcagtc

SEQ ID NO: 3537 - DNA, 19 bp, Artificial Sequence
  Description of Artificial Sequence: Chemically synthesized oligonucleotide
actgcgctggaaggaggcc

SEQ ID NO: 3538 - DNA, 19 bp, Artificial Sequence
  Description of Artificial Sequence: Chemically synthesized oligonucleotide
ggcctccttccagcgcagt

SEQ ID NO: 3539 - DNA, 19 bp, Artificial Sequence
  Description of Artificial Sequence: Chemically synthesized oligonucleotide
ctgcgctggaaggaggcca

SEQ ID NO: 3540 - DNA, 19 bp, Artificial Sequence
  Description of Artificial Sequence: Chemically synthesized oligonucleotide
tggcctccttccagcgcag

SEQ ID NO: 3541 - DNA, 19 bp, Artificial Sequence
  Description of Artificial Sequence: Chemically synthesized oligonucleotide
tgcgctggaaggaggccat

SEQ ID NO: 3542 - DNA, 19 bp, Artificial Sequence
  Description of Artificial Sequence: Chemically synthesized oligonucleotide
atggcctccttccagcgca

SEQ ID NO: 3543 - DNA, 19 bp, Artificial Sequence
  Description of Artificial Sequence: Chemically synthesized oligonucleotide
gcgctggaaggaggccatg

SEQ ID NO: 3544 - DNA, 19 bp, Artificial Sequence
  Description of Artificial Sequence: Chemically synthesized oligonucleotide
catggcctccttccagcgc

SEQ ID NO: 3545 - DNA, 19 bp, Artificial Sequence
  Description of Artificial Sequence: Chemically synthesized oligonucleotide
cgctggaaggaggccatgc

SEQ ID NO: 3546 - DNA, 19 bp, Artificial Sequence
  Description of Artificial Sequence: Chemically synthesized oligonucleotide
gcatggcctccttccagcg

SEQ ID NO: 3547 - DNA, 19 bp, Artificial Sequence
  Description of Artificial Sequence: Chemically synthesized oligonucleotide
gctggaaggaggccatgct

SEQ ID NO: 3548 - DNA, 19 bp, Artificial Sequence
  Description of Artificial Sequence: Chemically synthesized oligonucleotide
agcatggcctccttccagc

SEQ ID NO: 3549 - DNA, 19 bp, Artificial Sequence
  Description of Artificial Sequence: Chemically synthesized oligonucleotide
ctggaaggaggccatgctt

SEQ ID NO: 3550 - DNA, 19 bp, Artificial Sequence
  Description of Artificial Sequence: Chemically synthesized oligonucleotide
aagcatggcctccttccag

SEQ ID NO: 3551 - DNA, 19 bp, Artificial Sequence
  Description of Artificial Sequence: Chemically synthesized oligonucleotide
tggaaggaggccatgctta

SEQ ID NO: 3552 - DNA, 19 bp, Artificial Sequence
  Description of Artificial Sequence: Chemically synthesized oligonucleotide
taagcatggcctccttcca

SEQ ID NO: 3553 - DNA, 19 bp, Artificial Sequence
  Description of Artificial Sequence: Chemically synthesized oligonucleotide
ggaaggaggccatgcttac

SEQ ID NO: 3554 - DNA, 19 bp, Artificial Sequence
  Description of Artificial Sequence: Chemically synthesized oligonucleotide
gtaagcatggcctccttcc

SEQ ID NO: 3555 - DNA, 19 bp, Artificial Sequence
  Description of Artificial Sequence: Chemically synthesized oligonucleotide
gaaggaggccatgcttacc

SEQ ID NO: 3556 - DNA, 19 bp, Artificial Sequence
  Description of Artificial Sequence: Chemically synthesized oligonucleotide
ggtaagcatggcctccttc

SEQ ID NO: 3557 - DNA, 19 bp, Artificial Sequence
  Description of Artificial Sequence: Chemically synthesized oligonucleotide
aaggaggccatgcttaccc

SEQ ID NO: 3558 - DNA, 19 bp, Artificial Sequence
  Description of Artificial Sequence: Chemically synthesized oligonucleotide
gggtaagcatggcctcctt

SEQ ID NO: 3559 - DNA, 19 bp, Artificial Sequence
  Description of Artificial Sequence: Chemically synthesized oligonucleotide
aggaggccatgcttaccca

SEQ ID NO: 3560 - DNA, 19 bp, Artificial Sequence
  Description of Artificial Sequence: Chemically synthesized oligonucleotide
tgggtaagcatggcctcct

SEQ ID NO: 3561 - DNA, 19 bp, Artificial Sequence
  Description of Artificial Sequence: Chemically synthesized oligonucleotide
ggaggccatgcttacccat

SEQ ID NO: 3562 - DNA, 19 bp, Artificial Sequence
  Description of Artificial Sequence: Chemically synthesized oligonucleotide
atgggtaagcatggcctcc

SEQ ID NO: 3563 - DNA, 19 bp, Artificial Sequence
  Description of Artificial Sequence: Chemically synthesized oligonucleotide
gaggccatgcttacccatc

SEQ ID NO: 3564 - DNA, 19 bp, Artificial Sequence
  Description of Artificial Sequence: Chemically synthesized oligonucleotide
gatgggtaagcatggcctc

SEQ ID NO: 3565 - DNA, 19 bp, Artificial Sequence
  Description of Artificial Sequence: Chemically synthesized oligonucleotide
aggccatgcttacccatcc

SEQ ID NO: 3566 - DNA, 19 bp, Artificial Sequence
  Description of Artificial Sequence: Chemically synthesized oligonucleotide
ggatgggtaagcatggcct

SEQ ID NO: 3567 - DNA, 19 bp, Artificial Sequence
  Description of Artificial Sequence: Chemically synthesized oligonucleotide
ggccatgcttacccatccg

SEQ ID NO: 3568 - DNA, 19 bp, Artificial Sequence
  Description of Artificial Sequence: Chemically synthesized oligonucleotide
cggatgggtaagcatggcc

SEQ ID NO: 3569 - DNA, 19 bp, Artificial Sequence
  Description of Artificial Sequence: Chemically synthesized oligonucleotide
gccatgcttacccatccgc

SEQ ID NO: 3570 - DNA, 19 bp, Artificial Sequence
  Description of Artificial Sequence: Chemically synthesized oligonucleotide
gcggatgggtaagcatggc

SEQ ID NO: 3571 - DNA, 19 bp, Artificial Sequence
  Description of Artificial Sequence: Chemically synthesized oligonucleotide
ccatgcttacccatccgct

SEQ ID NO: 3572 - DNA, 19 bp, Artificial Sequence
  Description of Artificial Sequence: Chemically synthesized oligonucleotide
agcggatgggtaagcatgg

SEQ ID NO: 3573 - DNA, 19 bp, Artificial Sequence
  Description of Artificial Sequence: Chemically synthesized oligonucleotide
catgcttacccatccgctg

SEQ ID NO: 3574 - DNA, 19 bp, Artificial Sequence
  Description of Artificial Sequence: Chemically synthesized oligonucleotide
cagcggatgggtaagcatg

SEQ ID NO: 3575 - DNA, 19 bp, Artificial Sequence
  Description of Artificial Sequence: Chemically synthesized oligonucleotide
atgcttacccatccgctgg

SEQ ID NO: 3576 - DNA, 19 bp, Artificial Sequence
  Description of Artificial Sequence: Chemically synthesized oligonucleotide
ccagcggatgggtaagcat

SEQ ID NO: 3577 - DNA, 19 bp, Artificial Sequence
  Description of Artificial Sequence: Chemically synthesized oligonucleotide
tgcttacccatccgctggc

SEQ ID NO: 3578 - DNA, 19 bp, Artificial Sequence
  Description of Artificial Sequence: Chemically synthesized oligonucleotide
gccagcggatgggtaagca

SEQ ID NO: 3579 - DNA, 19 bp, Artificial Sequence
  Description of Artificial Sequence: Chemically synthesized oligonucleotide
gcttacccatccgctggca

SEQ ID NO: 3580 - DNA, 19 bp, Artificial Sequence
  Description of Artificial Sequence: Chemically synthesized oligonucleotide
tgccagcggatgggtaagc

SEQ ID NO: 3581 - DNA, 19 bp, Artificial Sequence
  Description of Artificial Sequence: Chemically synthesized oligonucleotide
cttacccatccgctggcat

SEQ ID NO: 3582 - DNA, 19 bp, Artificial Sequence
  Description of Artificial Sequence: Chemically synthesized oligonucleotide
atgccagcggatgggtaag

SEQ ID NO: 3583 - DNA, 19 bp, Artificial Sequence
  Description of Artificial Sequence: Chemically synthesized oligonucleotide
ttacccatccgctggcatt

SEQ ID NO: 3584 - DNA, 19 bp, Artificial Sequence
  Description of Artificial Sequence: Chemically synthesized oligonucleotide
aatgccagcggatgggtaa

SEQ ID NO: 3585 - DNA, 19 bp, Artificial Sequence
  Description of Artificial Sequence: Chemically synthesized oligonucleotide
tacccatccgctggcattc

SEQ ID NO: 3586 - DNA, 19 bp, Artificial Sequence
  Description of Artificial Sequence: Chemically synthesized oligonucleotide
gaatgccagcggatgggta

SEQ ID NO: 3587 - DNA, 19 bp, Artificial Sequence
  Description of Artificial Sequence: Chemically synthesized oligonucleotide
acccatccgctggcattct

SEQ ID NO: 3588 - DNA, 19 bp, Artificial Sequence
  Description of Artificial Sequence: Chemically synthesized oligonucleotide
agaatgccagcggatgggt

SEQ ID NO: 3589 - DNA, 19 bp, Artificial Sequence
  Description of Artificial Sequence: Chemically synthesized oligonucleotide
cccatccgctggcattctg

SEQ ID NO: 3590 - DNA, 19 bp, Artificial Sequence
  Description of Artificial Sequence: Chemically synthesized oligonucleotide
cagaatgccagcggatggg

SEQ ID NO: 3591 - DNA, 19 bp, Artificial Sequence
  Description of Artificial Sequence: Chemically synthesized oligonucleotide
ccatccgctggcattctgc

SEQ ID NO: 3592 - DNA, 19 bp, Artificial Sequence
  Description of Artificial Sequence: Chemically synthesized oligonucleotide
gcagaatgccagcggatgg

SEQ ID NO: 3593 - DNA, 19 bp, Artificial Sequence
  Description of Artificial Sequence: Chemically synthesized oligonucleotide
catccgctggcattctgcg

SEQ ID NO: 3594 - DNA, 19 bp, Artificial Sequence
  Description of Artificial Sequence: Chemically synthesized oligonucleotide
cgcagaatgccagcggatg

SEQ ID NO: 3595 - DNA, 19 bp, Artificial Sequence
  Description of Artificial Sequence: Chemically synthesized oligonucleotide
atccgctggcattctgcgg

SEQ ID NO: 3596 - DNA, 19 bp, Artificial Sequence
  Description of Artificial Sequence: Chemically synthesized oligonucleotide
ccgcagaatgccagcggat

SEQ ID NO: 3597 - DNA, 19 bp, Artificial Sequence
  Description of Artificial Sequence: Chemically synthesized oligonucleotide
tccgctggcattctgcggg

SEQ ID NO: 3598 - DNA, 19 bp, Artificial Sequence
  Description of Artificial Sequence: Chemically synthesized oligonucleotide
cccgcagaatgccagcgga

SEQ ID NO: 3599 - DNA, 19 bp, Artificial Sequence
  Description of Artificial Sequence: Chemically synthesized oligonucleotide
ccgctggcattctgcgggc

SEQ ID NO: 3600 - DNA, 19 bp, Artificial Sequence
  Description of Artificial Sequence: Chemically synthesized oligonucleotide
gcccgcagaatgccagcgg

SEQ ID NO: 3601 - DNA, 19 bp, Artificial Sequence
  Description of Artificial Sequence: Chemically synthesized oligonucleotide
cgctggcattctgcgggcc

SEQ ID NO: 3602 - DNA, 19 bp, Artificial Sequence
  Description of Artificial Sequence: Chemically synthesized oligonucleotide
ggcccgcagaatgccagcg

SEQ ID NO: 3603 - DNA, 19 bp, Artificial Sequence
  Description of Artificial Sequence: Chemically synthesized oligonucleotide
gctggcattctgcgggcca

SEQ ID NO: 3604 - DNA, 19 bp, Artificial Sequence
  Description of Artificial Sequence: Chemically synthesized oligonucleotide
tggcccgcagaatgccagc

SEQ ID NO: 3605 - DNA, 19 bp, Artificial Sequence
  Description of Artificial Sequence: Chemically synthesized oligonucleotide
ctggcattctgcgggccag

SEQ ID NO: 3606 - DNA, 19 bp, Artificial Sequence
  Description of Artificial Sequence: Chemically synthesized oligonucleotide
ctggcccgcagaatgccag

SEQ ID NO: 3607 - DNA, 19 bp, Artificial Sequence
  Description of Artificial Sequence: Chemically synthesized oligonucleotide
tggcattctgcgggccagc

SEQ ID NO: 3608 - DNA, 19 bp, Artificial Sequence
  Description of Artificial Sequence: Chemically synthesized oligonucleotide
gctggcccgcagaatgcca

SEQ ID NO: 3609 - DNA, 19 bp, Artificial Sequence
  Description of Artificial Sequence: Chemically synthesized oligonucleotide
ggcattctgcgggccagcg

SEQ ID NO: 3610 - DNA, 19 bp, Artificial Sequence
  Description of Artificial Sequence: Chemically synthesized oligonucleotide
cgctggcccgcagaatgcc

SEQ ID NO: 3611 - DNA, 19 bp, Artificial Sequence
  Description of Artificial Sequence: Chemically synthesized oligonucleotide
gcattctgcgggccagcgt

SEQ ID NO: 3612 - DNA, 19 bp, Artificial Sequence
  Description of Artificial Sequence: Chemically synthesized oligonucleotide
acgctggcccgcagaatgc

SEQ ID NO: 3613 - DNA, 19 bp, Artificial Sequence
  Description of Artificial Sequence: Chemically synthesized oligonucleotide
cattctgcgggccagcgtg

SEQ ID NO: 3614 - DNA, 19 bp, Artificial Sequence
  Description of Artificial Sequence: Chemically synthesized oligonucleotide
cacgctggcccgcagaatg

SEQ ID NO: 3615 - DNA, 19 bp, Artificial Sequence
  Description of Artificial Sequence: Chemically synthesized oligonucleotide
attctgcgggccagcgtgc

SEQ ID NO: 3616 - DNA, 19 bp, Artificial Sequence
  Description of Artificial Sequence: Chemically synthesized oligonucleotide
gcacgctggcccgcagaat

SEQ ID NO: 3617 - DNA, 19 bp, Artificial Sequence
  Description of Artificial Sequence: Chemically synthesized oligonucleotide
ttctgcgggccagcgtgcc

SEQ ID NO: 3618 - DNA, 19 bp, Artificial Sequence
  Description of Artificial Sequence: Chemically synthesized oligonucleotide
ggcacgctggcccgcagaa

SEQ ID NO: 3619 - DNA, 19 bp, Artificial Sequence
  Description of Artificial Sequence: Chemically synthesized oligonucleotide
tctgcgggccagcgtgccc

SEQ ID NO: 3620 - DNA, 19 bp, Artificial Sequence
  Description of Artificial Sequence: Chemically synthesized oligonucleotide
gggcacgctggcccgcaga

SEQ ID NO: 3621 - DNA, 19 bp, Artificial Sequence
  Description of Artificial Sequence: Chemically synthesized oligonucleotide
ctgcgggccagcgtgccca

SEQ ID NO: 3622 - DNA, 19 bp, Artificial Sequence
  Description of Artificial Sequence: Chemically synthesized oligonucleotide
tgggcacgctggcccgcag

SEQ ID NO: 3623 - DNA, 19 bp, Artificial Sequence
  Description of Artificial Sequence: Chemically synthesized oligonucleotide
tgcgggccagcgtgcccac

SEQ ID NO: 3624 - DNA, 19 bp, Artificial Sequence
  Description of Artificial Sequence: Chemically synthesized oligonucleotide
gtgggcacgctggcccgca

SEQ ID NO: 3625 - DNA, 19 bp, Artificial Sequence
  Description of Artificial Sequence: Chemically synthesized oligonucleotide
gcgggccagcgtgcccacc

SEQ ID NO: 3626 - DNA, 19 bp, Artificial Sequence
  Description of Artificial Sequence: Chemically synthesized oligonucleotide
ggtgggcacgctggcccgc

SEQ ID NO: 3627 - DNA, 19 bp, Artificial Sequence
  Description of Artificial Sequence: Chemically synthesized oligonucleotide
cgggccagcgtgcccacct

SEQ ID NO: 3628 - DNA, 19 bp, Artificial Sequence
  Description of Artificial Sequence: Chemically synthesized oligonucleotide
aggtgggcacgctggcccg

SEQ ID NO: 3629 - DNA, 19 bp, Artificial Sequence
  Description of Artificial Sequence: Chemically synthesized oligonucleotide
gggccagcgtgcccacctc

SEQ ID NO: 3630 - DNA, 19 bp, Artificial Sequence
  Description of Artificial Sequence: Chemically synthesized oligonucleotide
gaggtgggcacgctggccc

SEQ ID NO: 3631 - DNA, 19 bp, Artificial Sequence
  Description of Artificial Sequence: Chemically synthesized oligonucleotide
ggccagcgtgcccacctcg

SEQ ID NO: 3632 - DNA, 19 bp, Artificial Sequence
  Description of Artificial Sequence: Chemically synthesized oligonucleotide
cgaggtgggcacgctggcc

SEQ ID NO: 3633 - DNA, 19 bp, Artificial Sequence
  Description of Artificial Sequence: Chemically synthesized oligonucleotide
gccagcgtgcccacctcgc

SEQ ID NO: 3634 - DNA, 19 bp, Artificial Sequence
  Description of Artificial Sequence: Chemically synthesized oligonucleotide
gcgaggtgggcacgctggc

SEQ ID NO: 3635 - DNA, 19 bp, Artificial Sequence
  Description of Artificial Sequence: Chemically synthesized oligonucleotide
ccagcgtgcccacctcgct

SEQ ID NO: 3636 - DNA, 19 bp, Artificial Sequence
  Description of Artificial Sequence: Chemically synthesized oligonucleotide
agcgaggtgggcacgctgg

SEQ ID NO: 3637 - DNA, 19 bp, Artificial Sequence
  Description of Artificial Sequence: Chemically synthesized oligonucleotide
cagcgtgcccacctcgctg

SEQ ID NO: 3638 - DNA, 19 bp, Artificial Sequence
  Description of Artificial Sequence: Chemically synthesized oligonucleotide
cagcgaggtgggcacgctg

SEQ ID NO: 3639 - DNA, 19 bp, Artificial Sequence
  Description of Artificial Sequence: Chemically synthesized oligonucleotide
agcgtgcccacctcgctgt

SEQ ID NO: 3640 - DNA, 19 bp, Artificial Sequence
  Description of Artificial Sequence: Chemically synthesized oligonucleotide
acagcgaggtgggcacgct

SEQ ID NO: 3641 - DNA, 19 bp, Artificial Sequence
  Description of Artificial Sequence: Chemically synthesized oligonucleotide
gcgtgcccacctcgctgtg

SEQ ID NO: 3642 - DNA, 19 bp, Artificial Sequence
  Description of Artificial Sequence: Chemically synthesized oligonucleotide
cacagcgaggtgggcacgc

SEQ ID NO: 3643 - DNA, 19 bp, Artificial Sequence
  Description of Artificial Sequence: Chemically synthesized oligonucleotide
cgtgcccacctcgctgtgg

SEQ ID NO: 3644 - DNA, 19 bp, Artificial Sequence
  Description of Artificial Sequence: Chemically synthesized oligonucleotide
ccacagcgaggtgggcacg

SEQ ID NO: 3645 - DNA, 19 bp, Artificial Sequence
  Description of Artificial Sequence: Chemically synthesized oligonucleotide
gtgcccacctcgctgtggc

SEQ ID NO: 3646 - DNA, 19 bp, Artificial Sequence
  Description of Artificial Sequence: Chemically synthesized oligonucleotide
gccacagcgaggtgggcac

SEQ ID NO: 3647 - DNA, 19 bp, Artificial Sequence
  Description of Artificial Sequence: Chemically synthesized oligonucleotide
tgcccacctcgctgtggcc

SEQ ID NO: 3648 - DNA, 19 bp, Artificial Sequence
  Description of Artificial Sequence: Chemically synthesized oligonucleotide
ggccacagcgaggtgggca

SEQ ID NO: 3649 - DNA, 19 bp, Artificial Sequence
  Description of Artificial Sequence: Chemically synthesized oligonucleotide
gcccacctcgctgtggccc

SEQ ID NO: 3650 - DNA, 19 bp, Artificial Sequence
  Description of Artificial Sequence: Chemically synthesized oligonucleotide
gggccacagcgaggtgggc

SEQ ID NO: 3651 - DNA, 19 bp, Artificial Sequence
  Description of Artificial Sequence: Chemically synthesized oligonucleotide
cccacctcgctgtggcccc

SEQ ID NO: 3652 - DNA, 19 bp, Artificial Sequence
  Description of Artificial Sequence: Chemically synthesized oligonucleotide
ggggccacagcgaggtggg

SEQ ID NO: 3653 - DNA, 19 bp, Artificial Sequence
  Description of Artificial Sequence: Chemically synthesized oligonucleotide
ccacctcgctgtggccccc

SEQ ID NO: 3654 - DNA, 19 bp, Artificial Sequence
  Description of Artificial Sequence: Chemically synthesized oligonucleotide
gggggccacagcgaggtgg

SEQ ID NO: 3655 - DNA, 19 bp, Artificial Sequence
  Description of Artificial Sequence: Chemically synthesized oligonucleotide
cacctcgctgtggccccct

SEQ ID NO: 3656 - DNA, 19 bp, Artificial Sequence
  Description of Artificial Sequence: Chemically synthesized oligonucleotide
agggggccacagcgaggtg

SEQ ID NO: 3657 - DNA, 19 bp, Artificial Sequence
  Description of Artificial Sequence: Chemically synthesized oligonucleotide
acctcgctgtggccccctg

SEQ ID NO: 3658 - DNA, 19 bp, Artificial Sequence
  Description of Artificial Sequence: Chemically synthesized oligonucleotide
cagggggccacagcgaggt

SEQ ID NO: 3659 - DNA, 19 bp, Artificial Sequence
  Description of Artificial Sequence: Chemically synthesized oligonucleotide
cctcgctgtggccccctga

SEQ ID NO: 3660 - DNA, 19 bp, Artificial Sequence
  Description of Artificial Sequence: Chemically synthesized oligonucleotide
tcagggggccacagcgagg

SEQ ID NO: 3661 - DNA, 19 bp, Artificial Sequence
  Description of Artificial Sequence: Chemically synthesized oligonucleotide
ctcgctgtggccccctgat

SEQ ID NO: 3662 - DNA, 19 bp, Artificial Sequence
  Description of Artificial Sequence: Chemically synthesized oligonucleotide
atcagggggccacagcgag

SEQ ID NO: 3663 - DNA, 19 bp, Artificial Sequence
  Description of Artificial Sequence: Chemically synthesized oligonucleotide
tcgctgtggccccctgatg

SEQ ID NO: 3664 - DNA, 19 bp, Artificial Sequence
  Description of Artificial Sequence: Chemically synthesized oligonucleotide
catcagggggccacagcga

SEQ ID NO: 3665 - DNA, 19 bp, Artificial Sequence
  Description of Artificial Sequence: Chemically synthesized oligonucleotide
cgctgtggccccctgatgc

SEQ ID NO: 3666 - DNA, 19 bp, Artificial Sequence
  Description of Artificial Sequence: Chemically synthesized oligonucleotide
gcatcagggggccacagcg

SEQ ID NO: 3667 - DNA, 19 bp, Artificial Sequence
  Description of Artificial Sequence: Chemically synthesized oligonucleotide
gctgtggccccctgatgcc

SEQ ID NO: 3668 - DNA, 19 bp, Artificial Sequence
  Description of Artificial Sequence: Chemically synthesized oligonucleotide
ggcatcagggggccacagc

SEQ ID NO: 3669 - DNA, 19 bp, Artificial Sequence
  Description of Artificial Sequence: Chemically synthesized oligonucleotide
ctgtggccccctgatgcct

SEQ ID NO: 3670 - DNA, 19 bp, Artificial Sequence
  Description of Artificial Sequence: Chemically synthesized oligonucleotide
aggcatcagggggccacag

SEQ ID NO: 3671 - DNA, 19 bp, Artificial Sequence
  Description of Artificial Sequence: Chemically synthesized oligonucleotide
tgtggccccctgatgcctg

SEQ ID NO: 3672 - DNA, 19 bp, Artificial Sequence
  Description of Artificial Sequence: Chemically synthesized oligonucleotide
caggcatcagggggccaca

SEQ ID NO: 3673 - DNA, 19 bp, Artificial Sequence
  Description of Artificial Sequence: Chemically synthesized oligonucleotide
gtggccccctgatgcctga

SEQ ID NO: 3674 - DNA, 19 bp, Artificial Sequence
  Description of Artificial Sequence: Chemically synthesized oligonucleotide
tcaggcatcagggggccac

SEQ ID NO: 3675 - DNA, 19 bp, Artificial Sequence
  Description of Artificial Sequence: Chemically synthesized oligonucleotide
tggccccctgatgcctgag

SEQ ID NO: 3676 - DNA, 19 bp, Artificial Sequence
  Description of Artificial Sequence: Chemically synthesized oligonucleotide
ctcaggcatcagggggcca

SEQ ID NO: 3677 - DNA, 19 bp, Artificial Sequence
  Description of Artificial Sequence: Chemically synthesized oligonucleotide
ggccccctgatgcctgagc

SEQ ID NO: 3678 - DNA, 19 bp, Artificial Sequence
  Description of Artificial Sequence: Chemically synthesized oligonucleotide
gctcaggcatcagggggcc

SEQ ID NO: 3679 - DNA, 19 bp, Artificial Sequence
  Description of Artificial Sequence: Chemically synthesized oligonucleotide
gccccctgatgcctgagca

SEQ ID NO: 3680 - DNA, 19 bp, Artificial Sequence
  Description of Artificial Sequence: Chemically synthesized oligonucleotide
tgctcaggcatcagggggc

SEQ ID NO: 3681 - DNA, 19 bp, Artificial Sequence
  Description of Artificial Sequence: Chemically synthesized oligonucleotide
ccccctgatgcctgagcat

SEQ ID NO: 3682 - DNA, 19 bp, Artificial Sequence
  Description of Artificial Sequence: Chemically synthesized oligonucleotide
atgctcaggcatcaggggg

SEQ ID NO: 3683 - DNA, 19 bp, Artificial Sequence
  Description of Artificial Sequence: Chemically synthesized oligonucleotide
cccctgatgcctgagcata

SEQ ID NO: 3684 - DNA, 19 bp, Artificial Sequence
  Description of Artificial Sequence: Chemically synthesized oligonucleotide
tatgctcaggcatcagggg

SEQ ID NO: 3685 - DNA, 19 bp, Artificial Sequence
  Description of Artificial Sequence: Chemically synthesized oligonucleotide
ccctgatgcctgagcatag

SEQ ID NO: 3686 - DNA, 19 bp, Artificial Sequence
  Description of Artificial Sequence: Chemically synthesized oligonucleotide
ctatgctcaggcatcaggg

SEQ ID NO: 3687 - DNA, 19 bp, Artificial Sequence
  Description of Artificial Sequence: Chemically synthesized oligonucleotide
cctgatgcctgagcatagt

SEQ ID NO: 3688 - DNA, 19 bp, Artificial Sequence
  Description of Artificial Sequence: Chemically synthesized oligonucleotide
actatgctcaggcatcagg

SEQ ID NO: 3689 - DNA, 19 bp, Artificial Sequence
  Description of Artificial Sequence: Chemically synthesized oligonucleotide
ctgatgcctgagcatagtg

SEQ ID NO: 3690 - DNA, 19 bp, Artificial Sequence
  Description of Artificial Sequence: Chemically synthesized oligonucleotide
cactatgctcaggcatcag

SEQ ID NO: 3691 - DNA, 19 bp, Artificial Sequence
  Description of Artificial Sequence: Chemically synthesized oligonucleotide
tgatgcctgagcatagtgg

SEQ ID NO: 3692 - DNA, 19 bp, Artificial Sequence
  Description of Artificial Sequence: Chemically synthesized oligonucleotide
ccactatgctcaggcatca

SEQ ID NO: 3693 - DNA, 19 bp, Artificial Sequence
  Description of Artificial Sequence: Chemically synthesized oligonucleotide
gatgcctgagcatagtggt

SEQ ID NO: 3694 - DNA, 19 bp, Artificial Sequence
  Description of Artificial Sequence: Chemically synthesized oligonucleotide
accactatgctcaggcatc

SEQ ID NO: 3695 - DNA, 19 bp, Artificial Sequence
  Description of Artificial Sequence: Chemically synthesized oligonucleotide
atgcctgagcatagtggtg

SEQ ID NO: 3696 - DNA, 19 bp, Artificial Sequence
  Description of Artificial Sequence: Chemically synthesized oligonucleotide
caccactatgctcaggcat

SEQ ID NO: 3697 - DNA, 19 bp, Artificial Sequence
  Description of Artificial Sequence: Chemically synthesized oligonucleotide
tgcctgagcatagtggtgg

SEQ ID NO: 3698 - DNA, 19 bp, Artificial Sequence
  Description of Artificial Sequence: Chemically synthesized oligonucleotide
ccaccactatgctcaggca

SEQ ID NO: 3699 - DNA, 19 bp, Artificial Sequence
  Description of Artificial Sequence: Chemically synthesized oligonucleotide
gcctgagcatagtggtggc

SEQ ID NO: 3700 - DNA, 19 bp, Artificial Sequence
  Description of Artificial Sequence: Chemically synthesized oligonucleotide
gccaccactatgctcaggc

SEQ ID NO: 3701 - DNA, 19 bp, Artificial Sequence
  Description of Artificial Sequence: Chemically synthesized oligonucleotide
cctgagcatagtggtggcc

SEQ ID NO: 3702 - DNA, 19 bp, Artificial Sequence
  Description of Artificial Sequence: Chemically synthesized oligonucleotide
ggccaccactatgctcagg

SEQ ID NO: 3703 - DNA, 19 bp, Artificial Sequence
  Description of Artificial Sequence: Chemically synthesized oligonucleotide
ctgagcatagtggtggcca

SEQ ID NO: 3704 - DNA, 19 bp, Artificial Sequence
  Description of Artificial Sequence: Chemically synthesized oligonucleotide
tggccaccactatgctcag

SEQ ID NO: 3705 - DNA, 19 bp, Artificial Sequence
  Description of Artificial Sequence: Chemically synthesized oligonucleotide
tgagcatagtggtggccat

SEQ ID NO: 3706 - DNA, 19 bp, Artificial Sequence
  Description of Artificial Sequence: Chemically synthesized oligonucleotide
atggccaccactatgctca

SEQ ID NO: 3707 - DNA, 19 bp, Artificial Sequence
  Description of Artificial Sequence: Chemically synthesized oligonucleotide
gagcatagtggtggccatc

SEQ ID NO: 3708 - DNA, 19 bp, Artificial Sequence
  Description of Artificial Sequence: Chemically synthesized oligonucleotide
gatggccaccactatgctc

SEQ ID NO: 3709 - DNA, 19 bp, Artificial Sequence
  Description of Artificial Sequence: Chemically synthesized oligonucleotide
agcatagtggtggccatct

SEQ ID NO: 3710 - DNA, 19 bp, Artificial Sequence
  Description of Artificial Sequence: Chemically synthesized oligonucleotide
agatggccaccactatgct

SEQ ID NO: 3711 - DNA, 19 bp, Artificial Sequence
  Description of Artificial Sequence: Chemically synthesized oligonucleotide
gcatagtggtggccatctc

SEQ ID NO: 3712 - DNA, 19 bp, Artificial Sequence
  Description of Artificial Sequence: Chemically synthesized oligonucleotide
gagatggccaccactatgc

SEQ ID NO: 3713 - DNA, 19 bp, Artificial Sequence
  Description of Artificial Sequence: Chemically synthesized oligonucleotide
catagtggtggccatctca

SEQ ID NO: 3714 - DNA, 19 bp, Artificial Sequence
  Description of Artificial Sequence: Chemically synthesized oligonucleotide
tgagatggccaccactatg

SEQ ID NO: 3715 - DNA, 19 bp, Artificial Sequence
  Description of Artificial Sequence: Chemically synthesized oligonucleotide
atagtggtggccatctcaa

SEQ ID NO: 3716 - DNA, 19 bp, Artificial Sequence
  Description of Artificial Sequence: Chemically synthesized oligonucleotide
ttgagatggccaccactat

SEQ ID NO: 3717 - DNA, 19 bp, Artificial Sequence
  Description of Artificial Sequence: Chemically synthesized oligonucleotide
tagtggtggccatctcaag

SEQ ID NO: 3718 - DNA, 19 bp, Artificial Sequence
  Description of Artificial Sequence: Chemically synthesized oligonucleotide
cttgagatggccaccacta

SEQ ID NO: 3719 - DNA, 19 bp, Artificial Sequence
  Description of Artificial Sequence: Chemically synthesized oligonucleotide
agtggtggccatctcaaga

SEQ ID NO: 3720 - DNA, 19 bp, Artificial Sequence
  Description of Artificial Sequence: Chemically synthesized oligonucleotide
tcttgagatggccaccact

SEQ ID NO: 3721 - DNA, 19 bp, Artificial Sequence
  Description of Artificial Sequence: Chemically synthesized oligonucleotide
gtggtggccatctcaagag

SEQ ID NO: 3722 - DNA, 19 bp, Artificial Sequence
  Description of Artificial Sequence: Chemically synthesized oligonucleotide
ctcttgagatggccaccac

SEQ ID NO: 3723 - DNA, 19 bp, Artificial Sequence
  Description of Artificial Sequence: Chemically synthesized oligonucleotide
tggtggccatctcaagagt

SEQ ID NO: 3724 - DNA, 19 bp, Artificial Sequence
  Description of Artificial Sequence: Chemically synthesized oligonucleotide
actcttgagatggccacca

SEQ ID NO: 3725 - DNA, 19 bp, Artificial Sequence
  Description of Artificial Sequence: Chemically synthesized oligonucleotide
ggtggccatctcaagagtg

SEQ ID NO: 3726 - DNA, 19 bp, Artificial Sequence
  Description of Artificial Sequence: Chemically synthesized oligonucleotide
cactcttgagatggccacc

SEQ ID NO: 3727 - DNA, 19 bp, Artificial Sequence
  Description of Artificial Sequence: Chemically synthesized oligonucleotide
gtggccatctcaagagtga

SEQ ID NO: 3728 - DNA, 19 bp, Artificial Sequence
  Description of Artificial Sequence: Chemically synthesized oligonucleotide
tcactcttgagatggccac

SEQ ID NO: 3729 - DNA, 19 bp, Artificial Sequence
  Description of Artificial Sequence: Chemically synthesized oligonucleotide
tggccatctcaagagtgac

SEQ ID NO: 3730 - DNA, 19 bp, Artificial Sequence
  Description of Artificial Sequence: Chemically synthesized oligonucleotide
gtcactcttgagatggcca

SEQ ID NO: 3731 - DNA, 19 bp, Artificial Sequence
  Description of Artificial Sequence: Chemically synthesized oligonucleotide
ggccatctcaagagtgacc

SEQ ID NO: 3732 - DNA, 19 bp, Artificial Sequence
  Description of Artificial Sequence: Chemically synthesized oligonucleotide
ggtcactcttgagatggcc

SEQ ID NO: 3733 - DNA, 19 bp, Artificial Sequence
  Description of Artificial Sequence: Chemically synthesized oligonucleotide
gccatctcaagagtgaccc

SEQ ID NO: 3734 - DNA, 19 bp, Artificial Sequence
  Description of Artificial Sequence: Chemically synthesized oligonucleotide
gggtcactcttgagatggc

SEQ ID NO: 3735 - DNA, 19 bp, Artificial Sequence
  Description of Artificial Sequence: Chemically synthesized oligonucleotide
ccatctcaagagtgaccct

SEQ ID NO: 3736 - DNA, 19 bp, Artificial Sequence
  Description of Artificial Sequence: Chemically synthesized oligonucleotide
agggtcactcttgagatgg

SEQ ID NO: 3737 - DNA, 19 bp, Artificial Sequence
  Description of Artificial Sequence: Chemically synthesized oligonucleotide
catctcaagagtgaccctg

SEQ ID NO: 3738 - DNA, 19 bp, Artificial Sequence
  Description of Artificial Sequence: Chemically synthesized oligonucleotide
cagggtcactcttgagatg

SEQ ID NO: 3739 - DNA, 19 bp, Artificial Sequence
  Description of Artificial Sequence: Chemically synthesized oligonucleotide
atctcaagagtgaccctgt

SEQ ID NO: 3740 - DNA, 19 bp, Artificial Sequence
  Description of Artificial Sequence: Chemically synthesized oligonucleotide
acagggtcactcttgagat

SEQ ID NO: 3741 - DNA, 19 bp, Artificial Sequence
  Description of Artificial Sequence: Chemically synthesized oligonucleotide
tctcaagagtgaccctgtg

SEQ ID NO: 3742 - DNA, 19 bp, Artificial Sequence
  Description of Artificial Sequence: Chemically synthesized oligonucleotide
cacagggtcactcttgaga

SEQ ID NO: 3743 - DNA, 19 bp, Artificial Sequence
  Description of Artificial Sequence: Chemically synthesized oligonucleotide
ctcaagagtgaccctgtgg

SEQ ID NO: 3744 - DNA, 19 bp, Artificial Sequence
  Description of Artificial Sequence: Chemically synthesized oligonucleotide
ccacagggtcactcttgag

SEQ ID NO: 3745 - DNA, 19 bp, Artificial Sequence
  Description of Artificial Sequence: Chemically synthesized oligonucleotide
tcaagagtgaccctgtggc

SEQ ID NO: 3746 - DNA, 19 bp, Artificial Sequence
  Description of Artificial Sequence: Chemically synthesized oligonucleotide
gccacagggtcactcttga

SEQ ID NO: 3747 - DNA, 19 bp, Artificial Sequence
  Description of Artificial Sequence: Chemically synthesized oligonucleotide
caagagtgaccctgtggcc

SEQ ID NO: 3748 - DNA, 19 bp, Artificial Sequence
  Description of Artificial Sequence: Chemically synthesized oligonucleotide
ggccacagggtcactcttg

SEQ ID NO: 3749 - DNA, 19 bp, Artificial Sequence
  Description of Artificial Sequence: Chemically synthesized oligonucleotide
aagagtgaccctgtggcct

SEQ ID NO: 3750 - DNA, 19 bp, Artificial Sequence
  Description of Artificial Sequence: Chemically synthesized oligonucleotide
aggccacagggtcactctt

SEQ ID NO: 3751 - DNA, 19 bp, Artificial Sequence
  Description of Artificial Sequence: Chemically synthesized oligonucleotide
agagtgaccctgtggcctt

SEQ ID NO: 3752 - DNA, 19 bp, Artificial Sequence
  Description of Artificial Sequence: Chemically synthesized oligonucleotide
aaggccacagggtcactct

SEQ ID NO: 3753 - DNA, 19 bp, Artificial Sequence
  Description of Artificial Sequence: Chemically synthesized oligonucleotide
gagtgaccctgtggccttc

SEQ ID NO: 3754 - DNA, 19 bp, Artificial Sequence
  Description of Artificial Sequence: Chemically synthesized oligonucleotide
gaaggccacagggtcactc

SEQ ID NO: 3755 - DNA, 19 bp, Artificial Sequence
  Description of Artificial Sequence: Chemically synthesized oligonucleotide
agtgaccctgtggccttcc

SEQ ID NO: 3756 - DNA, 19 bp, Artificial Sequence
  Description of Artificial Sequence: Chemically synthesized oligonucleotide
ggaaggccacagggtcact

SEQ ID NO: 3757 - DNA, 19 bp, Artificial Sequence
  Description of Artificial Sequence: Chemically synthesized oligonucleotide
gtgaccctgtggccttccg

SEQ ID NO: 3758 - DNA, 19 bp, Artificial Sequence
  Description of Artificial Sequence: Chemically synthesized oligonucleotide
cggaaggccacagggtcac

SEQ ID NO: 3759 - DNA, 19 bp, Artificial Sequence
  Description of Artificial Sequence: Chemically synthesized oligonucleotide
tgaccctgtggccttccgg

SEQ ID NO: 3760 - DNA, 19 bp, Artificial Sequence
  Description of Artificial Sequence: Chemically synthesized oligonucleotide
ccggaaggccacagggtca

SEQ ID NO: 3761 - DNA, 19 bp, Artificial Sequence
  Description of Artificial Sequence: Chemically synthesized oligonucleotide
gaccctgtggccttccggc

SEQ ID NO: 3762 - DNA, 19 bp, Artificial Sequence
  Description of Artificial Sequence: Chemically synthesized oligonucleotide
gccggaaggccacagggtc

SEQ ID NO: 3763 - DNA, 19 bp, Artificial Sequence
  Description of Artificial Sequence: Chemically synthesized oligonucleotide
accctgtggccttccggcc

SEQ ID NO: 3764 - DNA, 19 bp, Artificial Sequence
  Description of Artificial Sequence: Chemically synthesized oligonucleotide
ggccggaaggccacagggt

SEQ ID NO: 3765 - DNA, 19 bp, Artificial Sequence
  Description of Artificial Sequence: Chemically synthesized oligonucleotide
ccctgtggccttccggccc

SEQ ID NO: 3766 - DNA, 19 bp, Artificial Sequence
  Description of Artificial Sequence: Chemically synthesized oligonucleotide
gggccggaaggccacaggg

SEQ ID NO: 3767 - DNA, 19 bp, Artificial Sequence
  Description of Artificial Sequence: Chemically synthesized oligonucleotide
cctgtggccttccggccct

SEQ ID NO: 3768 - DNA, 19 bp, Artificial Sequence
  Description of Artificial Sequence: Chemically synthesized oligonucleotide
agggccggaaggccacagg

SEQ ID NO: 3769 - DNA, 19 bp, Artificial Sequence
  Description of Artificial Sequence: Chemically synthesized oligonucleotide
ctgtggccttccggccctg

SEQ ID NO: 3770 - DNA, 19 bp, Artificial Sequence
  Description of Artificial Sequence: Chemically synthesized oligonucleotide
cagggccggaaggccacag

SEQ ID NO: 3771 - DNA, 19 bp, Artificial Sequence
  Description of Artificial Sequence: Chemically synthesized oligonucleotide
tgtggccttccggccctgg

SEQ ID NO: 3772 - DNA, 19 bp, Artificial Sequence
  Description of Artificial Sequence: Chemically synthesized oligonucleotide
ccagggccggaaggccaca

SEQ ID NO: 3773 - DNA, 19 bp, Artificial Sequence
  Description of Artificial Sequence: Chemically synthesized oligonucleotide
gtggccttccggccctggc

SEQ ID NO: 3774 - DNA, 19 bp, Artificial Sequence
  Description of Artificial Sequence: Chemically synthesized oligonucleotide
gccagggccggaaggccac

SEQ ID NO: 3775 - DNA, 19 bp, Artificial Sequence
  Description of Artificial Sequence: Chemically synthesized oligonucleotide
tggccttccggccctggca

SEQ ID NO: 3776 - DNA, 19 bp, Artificial Sequence
  Description of Artificial Sequence: Chemically synthesized oligonucleotide
tgccagggccggaaggcca

SEQ ID NO: 3777 - DNA, 19 bp, Artificial Sequence
  Description of Artificial Sequence: Chemically synthesized oligonucleotide
ggccttccggccctggcac

SEQ ID NO: 3778 - DNA, 19 bp, Artificial Sequence
  Description of Artificial Sequence: Chemically synthesized oligonucleotide
gtgccagggccggaaggcc

SEQ ID NO: 3779 - DNA, 19 bp, Artificial Sequence
  Description of Artificial Sequence: Chemically synthesized oligonucleotide
gccttccggccctggcact

SEQ ID NO: 3780 - DNA, 19 bp, Artificial Sequence
  Description of Artificial Sequence: Chemically synthesized oligonucleotide
agtgccagggccggaaggc

SEQ ID NO: 3781 - DNA, 19 bp, Artificial Sequence
  Description of Artificial Sequence: Chemically synthesized oligonucleotide
ccttccggccctggcactg

SEQ ID NO: 3782 - DNA, 19 bp, Artificial Sequence
  Description of Artificial Sequence: Chemically synthesized oligonucleotide
cagtgccagggccggaagg

SEQ ID NO: 3783 - DNA, 19 bp, Artificial Sequence
  Description of Artificial Sequence: Chemically synthesized oligonucleotide
cttccggccctggcactgc

SEQ ID NO: 3784 - DNA, 19 bp, Artificial Sequence
  Description of Artificial Sequence: Chemically synthesized oligonucleotide
gcagtgccagggccggaag

SEQ ID NO: 3785 - DNA, 19 bp, Artificial Sequence
  Description of Artificial Sequence: Chemically synthesized oligonucleotide
ttccggccctggcactgcc

SEQ ID NO: 3786 - DNA, 19 bp, Artificial Sequence
  Description of Artificial Sequence: Chemically synthesized oligonucleotide
ggcagtgccagggccggaa

SEQ ID NO: 3787 - DNA, 19 bp, Artificial Sequence
  Description of Artificial Sequence: Chemically synthesized oligonucleotide
tccggccctggcactgccc

SEQ ID NO: 3788 - DNA, 19 bp, Artificial Sequence
  Description of Artificial Sequence: Chemically synthesized oligonucleotide
gggcagtgccagggccgga

SEQ ID NO: 3789 - DNA, 19 bp, Artificial Sequence
  Description of Artificial Sequence: Chemically synthesized oligonucleotide
ccggccctggcactgccct

SEQ ID NO: 3790 - DNA, 19 bp, Artificial Sequence
  Description of Artificial Sequence: Chemically synthesized oligonucleotide
agggcagtgccagggccgg

SEQ ID NO: 3791 - DNA, 19 bp, Artificial Sequence
  Description of Artificial Sequence: Chemically synthesized oligonucleotide
cggccctggcactgccctt

SEQ ID NO: 3792 - DNA, 19 bp, Artificial Sequence
  Description of Artificial Sequence: Chemically synthesized oligonucleotide
aagggcagtgccagggccg

SEQ ID NO: 3793 - DNA, 19 bp, Artificial Sequence
  Description of Artificial Sequence: Chemically synthesized oligonucleotide
ggccctggcactgcccttt

SEQ ID NO: 3794 - DNA, 19 bp, Artificial Sequence
  Description of Artificial Sequence: Chemically synthesized oligonucleotide
aaagggcagtgccagggcc

SEQ ID NO: 3795 - DNA, 19 bp, Artificial Sequence
  Description of Artificial Sequence: Chemically synthesized oligonucleotide
gccctggcactgccctttc

SEQ ID NO: 3796 - DNA, 19 bp, Artificial Sequence
  Description of Artificial Sequence: Chemically synthesized oligonucleotide
gaaagggcagtgccagggc

SEQ ID NO: 3797 - DNA, 19 bp, Artificial Sequence
  Description of Artificial Sequence: Chemically synthesized oligonucleotide
ccctggcactgccctttcc

SEQ ID NO: 3798 - DNA, 19 bp, Artificial Sequence
  Description of Artificial Sequence: Chemically synthesized oligonucleotide
ggaaagggcagtgccaggg

SEQ ID NO: 3799 - DNA, 19 bp, Artificial Sequence
  Description of Artificial Sequence: Chemically synthesized oligonucleotide
cctggcactgccctttcct

SEQ ID NO: 3800 - DNA, 19 bp, Artificial Sequence
  Description of Artificial Sequence: Chemically synthesized oligonucleotide
aggaaagggcagtgccagg

SEQ ID NO: 3801 - DNA, 19 bp, Artificial Sequence
  Description of Artificial Sequence: Chemically synthesized oligonucleotide
ctggcactgccctttcctt

SEQ ID NO: 3802 - DNA, 19 bp, Artificial Sequence
  Description of Artificial Sequence: Chemically synthesized oligonucleotide
aaggaaagggcagtgccag

SEQ ID NO: 3803 - DNA, 19 bp, Artificial Sequence
  Description of Artificial Sequence: Chemically synthesized oligonucleotide
tggcactgccctttccttc

SEQ ID NO: 3804 - DNA, 19 bp, Artificial Sequence
  Description of Artificial Sequence: Chemically synthesized oligonucleotide
gaaggaaagggcagtgcca

SEQ ID NO: 3805 - DNA, 19 bp, Artificial Sequence
  Description of Artificial Sequence: Chemically synthesized oligonucleotide
ggcactgccctttccttct

SEQ ID NO: 3806 - DNA, 19 bp, Artificial Sequence
  Description of Artificial Sequence: Chemically synthesized oligonucleotide
agaaggaaagggcagtgcc

SEQ ID NO: 3807 - DNA, 19 bp, Artificial Sequence
  Description of Artificial Sequence: Chemically synthesized oligonucleotide
gcactgccctttccttctg

SEQ ID NO: 3808 - DNA, 19 bp, Artificial Sequence
  Description of Artificial Sequence: Chemically synthesized oligonucleotide
cagaaggaaagggcagtgc

SEQ ID NO: 3809 - DNA, 19 bp, Artificial Sequence
  Description of Artificial Sequence: Chemically synthesized oligonucleotide
cactgccctttccttctgg

SEQ ID NO: 3810 - DNA, 19 bp, Artificial Sequence
  Description of Artificial Sequence: Chemically synthesized oligonucleotide
ccagaaggaaagggcagtg

SEQ ID NO: 3811 - DNA, 19 bp, Artificial Sequence
  Description of Artificial Sequence: Chemically synthesized oligonucleotide
actgccctttccttctgga

SEQ ID NO: 3812 - DNA, 19 bp, Artificial Sequence
  Description of Artificial Sequence: Chemically synthesized oligonucleotide
tccagaaggaaagggcagt

SEQ ID NO: 3813 - DNA, 19 bp, Artificial Sequence
  Description of Artificial Sequence: Chemically synthesized oligonucleotide
ctgccctttccttctggag

SEQ ID NO: 3814 - DNA, 19 bp, Artificial Sequence
  Description of Artificial Sequence: Chemically synthesized oligonucleotide
ctccagaaggaaagggcag

SEQ ID NO: 3815 - DNA, 19 bp, Artificial Sequence
  Description of Artificial Sequence: Chemically synthesized oligonucleotide
tgccctttccttctggaga

SEQ ID NO: 3816 - DNA, 19 bp, Artificial Sequence
  Description of Artificial Sequence: Chemically synthesized oligonucleotide
tctccagaaggaaagggca

SEQ ID NO: 3817 - DNA, 19 bp, Artificial Sequence
  Description of Artificial Sequence: Chemically synthesized oligonucleotide
gccctttccttctggagac

SEQ ID NO: 3818 - DNA, 19 bp, Artificial Sequence
  Description of Artificial Sequence: Chemically synthesized oligonucleotide
gtctccagaaggaaagggc

SEQ ID NO: 3819 - DNA, 19 bp, Artificial Sequence
  Description of Artificial Sequence: Chemically synthesized oligonucleotide
ccctttccttctggagacc

SEQ ID NO: 3820 - DNA, 19 bp, Artificial Sequence
  Description of Artificial Sequence: Chemically synthesized oligonucleotide
ggtctccagaaggaaaggg

SEQ ID NO: 3821 - DNA, 19 bp, Artificial Sequence
  Description of Artificial Sequence: Chemically synthesized oligonucleotide
cctttccttctggagacca

SEQ ID NO: 3822 - DNA, 19 bp, Artificial Sequence
  Description of Artificial Sequence: Chemically synthesized oligonucleotide
tggtctccagaaggaaagg

SEQ ID NO: 3823 - DNA, 19 bp, Artificial Sequence
  Description of Artificial Sequence: Chemically synthesized oligonucleotide
ctttccttctggagaccaa

SEQ ID NO: 3824 - DNA, 19 bp, Artificial Sequence
  Description of Artificial Sequence: Chemically synthesized oligonucleotide
ttggtctccagaaggaaag

SEQ ID NO: 3825 - DNA, 19 bp, Artificial Sequence
  Description of Artificial Sequence: Chemically synthesized oligonucleotide
tttccttctggagaccaag

SEQ ID NO: 3826 - DNA, 19 bp, Artificial Sequence
  Description of Artificial Sequence: Chemically synthesized oligonucleotide
cttggtctccagaaggaaa

SEQ ID NO: 3827 - DNA, 19 bp, Artificial Sequence
  Description of Artificial Sequence: Chemically synthesized oligonucleotide
ttccttctggagaccaaga

SEQ ID NO: 3828 - DNA, 19 bp, Artificial Sequence
  Description of Artificial Sequence: Chemically synthesized oligonucleotide
tcttggtctccagaaggaa

SEQ ID NO: 3829 - DNA, 19 bp, Artificial Sequence
  Description of Artificial Sequence: Chemically synthesized oligonucleotide
tccttctggagaccaagat

SEQ ID NO: 3830 - DNA, 19 bp, Artificial Sequence
  Description of Artificial Sequence: Chemically synthesized oligonucleotide
atcttggtctccagaagga

SEQ ID NO: 3831 - DNA, 19 bp, Artificial Sequence
  Description of Artificial Sequence: Chemically synthesized oligonucleotide
ccttctggagaccaagatc

SEQ ID NO: 3832 - DNA, 19 bp, Artificial Sequence
  Description of Artificial Sequence: Chemically synthesized oligonucleotide
gatcttggtctccagaagg

SEQ ID NO: 3833 - DNA, 19 bp, Artificial Sequence
  Description of Artificial Sequence: Chemically synthesized oligonucleotide
cttctggagaccaagatcc

SEQ ID NO: 3834 - DNA, 19 bp, Artificial Sequence
  Description of Artificial Sequence: Chemically synthesized oligonucleotide
ggatcttggtctccagaag

SEQ ID NO: 3835 - DNA, 19 bp, Artificial Sequence
  Description of Artificial Sequence: Chemically synthesized oligonucleotide
ttctggagaccaagatcct

SEQ ID NO: 3836 - DNA, 19 bp, Artificial Sequence
  Description of Artificial Sequence: Chemically synthesized oligonucleotide
aggatcttggtctccagaa

SEQ ID NO: 3837 - DNA, 19 bp, Artificial Sequence
  Description of Artificial Sequence: Chemically synthesized oligonucleotide
tctggagaccaagatcctg

SEQ ID NO: 3838 - DNA, 19 bp, Artificial Sequence
  Description of Artificial Sequence: Chemically synthesized oligonucleotide
caggatcttggtctccaga

SEQ ID NO: 3839 - DNA, 19 bp, Artificial Sequence
  Description of Artificial Sequence: Chemically synthesized oligonucleotide
ctggagaccaagatcctgg

SEQ ID NO: 3840 - DNA, 19 bp, Artificial Sequence
  Description of Artificial Sequence: Chemically synthesized oligonucleotide
ccaggatcttggtctccag

SEQ ID NO: 3841 - DNA, 19 bp, Artificial Sequence
  Description of Artificial Sequence: Chemically synthesized oligonucleotide
tggagaccaagatcctgga

SEQ ID NO: 3842 - DNA, 19 bp, Artificial Sequence
  Description of Artificial Sequence: Chemically synthesized oligonucleotide
tccaggatcttggtctcca

SEQ ID NO: 3843 - DNA, 19 bp, Artificial Sequence
  Description of Artificial Sequence: Chemically synthesized oligonucleotide
ggagaccaagatcctggag

SEQ ID NO: 3844 - DNA, 19 bp, Artificial Sequence
  Description of Artificial Sequence: Chemically synthesized oligonucleotide
ctccaggatcttggtctcc

SEQ ID NO: 3845 - DNA, 19 bp, Artificial Sequence
  Description of Artificial Sequence: Chemically synthesized oligonucleotide
gagaccaagatcctggagc

SEQ ID NO: 3846 - DNA, 19 bp, Artificial Sequence
  Description of Artificial Sequence: Chemically synthesized oligonucleotide
gctccaggatcttggtctc

SEQ ID NO: 3847 - DNA, 19 bp, Artificial Sequence
  Description of Artificial Sequence: Chemically synthesized oligonucleotide
agaccaagatcctggagcg

SEQ ID NO: 3848 - DNA, 19 bp, Artificial Sequence
  Description of Artificial Sequence: Chemically synthesized oligonucleotide
cgctccaggatcttggtct

SEQ ID NO: 3849 - DNA, 19 bp, Artificial Sequence
  Description of Artificial Sequence: Chemically synthesized oligonucleotide
gaccaagatcctggagcga

SEQ ID NO: 3850 - DNA, 19 bp, Artificial Sequence
  Description of Artificial Sequence: Chemically synthesized oligonucleotide
tcgctccaggatcttggtc

SEQ ID NO: 3851 - DNA, 19 bp, Artificial Sequence
  Description of Artificial Sequence: Chemically synthesized oligonucleotide
accaagatcctggagcgag

SEQ ID NO: 3852 - DNA, 19 bp, Artificial Sequence
  Description of Artificial Sequence: Chemically synthesized oligonucleotide
ctcgctccaggatcttggt

SEQ ID NO: 3853 - DNA, 19 bp, Artificial Sequence
  Description of Artificial Sequence: Chemically synthesized oligonucleotide
ccaagatcctggagcgagc

SEQ ID NO: 3854 - DNA, 19 bp, Artificial Sequence
  Description of Artificial Sequence: Chemically synthesized oligonucleotide
gctcgctccaggatcttgg

SEQ ID NO: 3855 - DNA, 19 bp, Artificial Sequence
  Description of Artificial Sequence: Chemically synthesized oligonucleotide
caagatcctggagcgagct

SEQ ID NO: 3856 - DNA, 19 bp, Artificial Sequence
  Description of Artificial Sequence: Chemically synthesized oligonucleotide
agctcgctccaggatcttg

SEQ ID NO: 3857 - DNA, 19 bp, Artificial Sequence
  Description of Artificial Sequence: Chemically synthesized oligonucleotide
aagatcctggagcgagctc

SEQ ID NO: 3858 - DNA, 19 bp, Artificial Sequence
  Description of Artificial Sequence: Chemically synthesized oligonucleotide
gagctcgctccaggatctt

SEQ ID NO: 3859 - DNA, 19 bp, Artificial Sequence
  Description of Artificial Sequence: Chemically synthesized oligonucleotide
agatcctggagcgagctcc

SEQ ID NO: 3860 - DNA, 19 bp, Artificial Sequence
  Description of Artificial Sequence: Chemically synthesized oligonucleotide
ggagctcgctccaggatct

SEQ ID NO: 3861 - DNA, 19 bp, Artificial Sequence
  Description of Artificial Sequence: Chemically synthesized oligonucleotide
gatcctggagcgagctccc

SEQ ID NO: 3862 - DNA, 19 bp, Artificial Sequence
  Description of Artificial Sequence: Chemically synthesized oligonucleotide
gggagctcgctccaggatc

SEQ ID NO: 3863 - DNA, 19 bp, Artificial Sequence
  Description of Artificial Sequence: Chemically synthesized oligonucleotide
atcctggagcgagctccct

SEQ ID NO: 3864 - DNA, 19 bp, Artificial Sequence
  Description of Artificial Sequence: Chemically synthesized oligonucleotide
agggagctcgctccaggat

SEQ ID NO: 3865 - DNA, 19 bp, Artificial Sequence
  Description of Artificial Sequence: Chemically synthesized oligonucleotide
tcctggagcgagctccctt

SEQ ID NO: 3866 - DNA, 19 bp, Artificial Sequence
  Description of Artificial Sequence: Chemically synthesized oligonucleotide
aagggagctcgctccagga

SEQ ID NO: 3867 - DNA, 19 bp, Artificial Sequence
  Description of Artificial Sequence: Chemically synthesized oligonucleotide
cctggagcgagctcccttc

SEQ ID NO: 3868 - DNA, 19 bp, Artificial Sequence
  Description of Artificial Sequence: Chemically synthesized oligonucleotide
gaagggagctcgctccagg

SEQ ID NO: 3869 - DNA, 19 bp, Artificial Sequence
  Description of Artificial Sequence: Chemically synthesized oligonucleotide
ctggagcgagctcccttct

SEQ ID NO: 3870 - DNA, 19 bp, Artificial Sequence
  Description of Artificial Sequence: Chemically synthesized oligonucleotide
agaagggagctcgctccag

SEQ ID NO: 3871 - DNA, 19 bp, Artificial Sequence
  Description of Artificial Sequence: Chemically synthesized oligonucleotide
tggagcgagctcccttctg

SEQ ID NO: 3872 - DNA, 19 bp, Artificial Sequence
  Description of Artificial Sequence: Chemically synthesized oligonucleotide
cagaagggagctcgctcca

SEQ ID NO: 3873 - DNA, 19 bp, Artificial Sequence
  Description of Artificial Sequence: Chemically synthesized oligonucleotide
ggagcgagctcccttctgg

SEQ ID NO: 3874 - DNA, 19 bp, Artificial Sequence
  Description of Artificial Sequence: Chemically synthesized oligonucleotide
ccagaagggagctcgctcc

SEQ ID NO: 3875 - DNA, 19 bp, Artificial Sequence
  Description of Artificial Sequence: Chemically synthesized oligonucleotide
gagcgagctcccttctggg

SEQ ID NO: 3876 - DNA, 19 bp, Artificial Sequence
  Description of Artificial Sequence: Chemically synthesized oligonucleotide
cccagaagggagctcgctc

SEQ ID NO: 3877 - DNA, 19 bp, Artificial Sequence
  Description of Artificial Sequence: Chemically synthesized oligonucleotide
agcgagctcccttctgggt

SEQ ID NO: 3878 - DNA, 19 bp, Artificial Sequence
  Description of Artificial Sequence: Chemically synthesized oligonucleotide
acccagaagggagctcgct

SEQ ID NO: 3879 - DNA, 19 bp, Artificial Sequence
  Description of Artificial Sequence: Chemically synthesized oligonucleotide
gcgagctcccttctgggtg

SEQ ID NO: 3880 - DNA, 19 bp, Artificial Sequence
  Description of Artificial Sequence: Chemically synthesized oligonucleotide
cacccagaagggagctcgc

SEQ ID NO: 3881 - DNA, 19 bp, Artificial Sequence
  Description of Artificial Sequence: Chemically synthesized oligonucleotide
cgagctcccttctgggtgc

SEQ ID NO: 3882 - DNA, 19 bp, Artificial Sequence
  Description of Artificial Sequence: Chemically synthesized oligonucleotide
gcacccagaagggagctcg

SEQ ID NO: 3883 - DNA, 19 bp, Artificial Sequence
  Description of Artificial Sequence: Chemically synthesized oligonucleotide
gagctcccttctgggtgcc

SEQ ID NO: 3884 - DNA, 19 bp, Artificial Sequence
  Description of Artificial Sequence: Chemically synthesized oligonucleotide
ggcacccagaagggagctc

SEQ ID NO: 3885 - DNA, 19 bp, Artificial Sequence
  Description of Artificial Sequence: Chemically synthesized oligonucleotide
agctcccttctgggtgccc

SEQ ID NO: 3886 - DNA, 19 bp, Artificial Sequence
  Description of Artificial Sequence: Chemically synthesized oligonucleotide
gggcacccagaagggagct

SEQ ID NO: 3887 - DNA, 19 bp, Artificial Sequence
  Description of Artificial Sequence: Chemically synthesized oligonucleotide
gctcccttctgggtgccca

SEQ ID NO: 3888 - DNA, 19 bp, Artificial Sequence
  Description of Artificial Sequence: Chemically synthesized oligonucleotide
tgggcacccagaagggagc

SEQ ID NO: 3889 - DNA, 19 bp, Artificial Sequence
  Description of Artificial Sequence: Chemically synthesized oligonucleotide
ctcccttctgggtgcccac

SEQ ID NO: 3890 - DNA, 19 bp, Artificial Sequence
  Description of Artificial Sequence: Chemically synthesized oligonucleotide
gtgggcacccagaagggag

SEQ ID NO: 3891 - DNA, 19 bp, Artificial Sequence
  Description of Artificial Sequence: Chemically synthesized oligonucleotide
tcccttctgggtgcccacc

SEQ ID NO: 3892 - DNA, 19 bp, Artificial Sequence
  Description of Artificial Sequence: Chemically synthesized oligonucleotide
ggtgggcacccagaaggga

SEQ ID NO: 3893 - DNA, 19 bp, Artificial Sequence
  Description of Artificial Sequence: Chemically synthesized oligonucleotide
cccttctgggtgcccacct

SEQ ID NO: 3894 - DNA, 19 bp, Artificial Sequence
  Description of Artificial Sequence: Chemically synthesized oligonucleotide
aggtgggcacccagaaggg

SEQ ID NO: 3895 - DNA, 19 bp, Artificial Sequence
  Description of Artificial Sequence: Chemically synthesized oligonucleotide
ccttctgggtgcccacctg

SEQ ID NO: 3896 - DNA, 19 bp, Artificial Sequence
  Description of Artificial Sequence: Chemically synthesized oligonucleotide
caggtgggcacccagaagg

SEQ ID NO: 3897 - DNA, 19 bp, Artificial Sequence
  Description of Artificial Sequence: Chemically synthesized oligonucleotide
cttctgggtgcccacctgc

SEQ ID NO: 3898 - DNA, 19 bp, Artificial Sequence
  Description of Artificial Sequence: Chemically synthesized oligonucleotide
gcaggtgggcacccagaag

SEQ ID NO: 3899 - DNA, 19 bp, Artificial Sequence
  Description of Artificial Sequence: Chemically synthesized oligonucleotide
ttctgggtgcccacctgct

SEQ ID NO: 3900 - DNA, 19 bp, Artificial Sequence
  Description of Artificial Sequence: Chemically synthesized oligonucleotide
agcaggtgggcacccagaa

SEQ ID NO: 3901 - DNA, 19 bp, Artificial Sequence
  Description of Artificial Sequence: Chemically synthesized oligonucleotide
tctgggtgcccacctgctt

SEQ ID NO: 3902 - DNA, 19 bp, Artificial Sequence
  Description of Artificial Sequence: Chemically synthesized oligonucleotide
aagcaggtgggcacccaga

SEQ ID NO: 3903 - DNA, 19 bp, Artificial Sequence
  Description of Artificial Sequence: Chemically synthesized oligonucleotide
ctgggtgcccacctgcttg

SEQ ID NO: 3904 - DNA, 19 bp, Artificial Sequence
  Description of Artificial Sequence: Chemically synthesized oligonucleotide
caagcaggtgggcacccag

SEQ ID NO: 3905 - DNA, 19 bp, Artificial Sequence
  Description of Artificial Sequence: Chemically synthesized oligonucleotide
tgggtgcccacctgcttgc

SEQ ID NO: 3906 - DNA, 19 bp, Artificial Sequence
  Description of Artificial Sequence: Chemically synthesized oligonucleotide
gcaagcaggtgggcaccca

SEQ ID NO: 3907 - DNA, 19 bp, Artificial Sequence
  Description of Artificial Sequence: Chemically synthesized oligonucleotide
gggtgcccacctgcttgcc

SEQ ID NO: 3908 - DNA, 19 bp, Artificial Sequence
  Description of Artificial Sequence: Chemically synthesized oligonucleotide
ggcaagcaggtgggcaccc

SEQ ID NO: 3909 - DNA, 19 bp, Artificial Sequence
  Description of Artificial Sequence: Chemically synthesized oligonucleotide
ggtgcccacctgcttgcca

SEQ ID NO: 3910 - DNA, 19 bp, Artificial Sequence
  Description of Artificial Sequence: Chemically synthesized oligonucleotide
tggcaagcaggtgggcacc

SEQ ID NO: 3911 - DNA, 19 bp, Artificial Sequence
  Description of Artificial Sequence: Chemically synthesized oligonucleotide
gtgcccacctgcttgccac

SEQ ID NO: 3912 - DNA, 19 bp, Artificial Sequence
  Description of Artificial Sequence: Chemically synthesized oligonucleotide
gtggcaagcaggtgggcac

SEQ ID NO: 3913 - DNA, 19 bp, Artificial Sequence
  Description of Artificial Sequence: Chemically synthesized oligonucleotide
tgcccacctgcttgccacc

SEQ ID NO: 3914 - DNA, 19 bp, Artificial Sequence
  Description of Artificial Sequence: Chemically synthesized oligonucleotide
ggtggcaagcaggtgggca

SEQ ID NO: 3915 - DNA, 19 bp, Artificial Sequence
  Description of Artificial Sequence: Chemically synthesized oligonucleotide
gcccacctgcttgccaccc

SEQ ID NO: 3916 - DNA, 19 bp, Artificial Sequence
  Description of Artificial Sequence: Chemically synthesized oligonucleotide
gggtggcaagcaggtgggc

SEQ ID NO: 3917 - DNA, 19 bp, Artificial Sequence
  Description of Artificial Sequence: Chemically synthesized oligonucleotide
cccacctgcttgccaccct

SEQ ID NO: 3918 - DNA, 19 bp, Artificial Sequence
  Description of Artificial Sequence: Chemically synthesized oligonucleotide
agggtggcaagcaggtggg

SEQ ID NO: 3919 - DNA, 19 bp, Artificial Sequence
  Description of Artificial Sequence: Chemically synthesized oligonucleotide
ccacctgcttgccacccta

SEQ ID NO: 3920 - DNA, 19 bp, Artificial Sequence
  Description of Artificial Sequence: Chemically synthesized oligonucleotide
tagggtggcaagcaggtgg

SEQ ID NO: 3921 - DNA, 19 bp, Artificial Sequence
  Description of Artificial Sequence: Chemically synthesized oligonucleotide
cacctgcttgccaccctac

SEQ ID NO: 3922 - DNA, 19 bp, Artificial Sequence
  Description of Artificial Sequence: Chemically synthesized oligonucleotide
gtagggtggcaagcaggtg

SEQ ID NO: 3923 - DNA, 19 bp, Artificial Sequence
  Description of Artificial Sequence: Chemically synthesized oligonucleotide
acctgcttgccaccctacc

SEQ ID NO: 3924 - DNA, 19 bp, Artificial Sequence
  Description of Artificial Sequence: Chemically synthesized oligonucleotide
ggtagggtggcaagcaggt

SEQ ID NO: 3925 - DNA, 19 bp, Artificial Sequence
  Description of Artificial Sequence: Chemically synthesized oligonucleotide
cctgcttgccaccctacct

SEQ ID NO: 3926 - DNA, 19 bp, Artificial Sequence
  Description of Artificial Sequence: Chemically synthesized oligonucleotide
aggtagggtggcaagcagg

SEQ ID NO: 3927 - DNA, 19 bp, Artificial Sequence
  Description of Artificial Sequence: Chemically synthesized oligonucleotide
ctgcttgccaccctaccta

SEQ ID NO: 3928 - DNA, 19 bp, Artificial Sequence
  Description of Artificial Sequence: Chemically synthesized oligonucleotide
taggtagggtggcaagcag

SEQ ID NO: 3929 - DNA, 19 bp, Artificial Sequence
  Description of Artificial Sequence: Chemically synthesized oligonucleotide
tgcttgccaccctacctag

SEQ ID NO: 3930 - DNA, 19 bp, Artificial Sequence
  Description of Artificial Sequence: Chemically synthesized oligonucleotide
ctaggtagggtggcaagca

SEQ ID NO: 3931 - DNA, 19 bp, Artificial Sequence
  Description of Artificial Sequence: Chemically synthesized oligonucleotide
gcttgccaccctacctagt

SEQ ID NO: 3932 - DNA, 19 bp, Artificial Sequence
  Description of Artificial Sequence: Chemically synthesized oligonucleotide
actaggtagggtggcaagc

SEQ ID NO: 3933 - DNA, 19 bp, Artificial Sequence
  Description of Artificial Sequence: Chemically synthesized oligonucleotide
cttgccaccctacctagtg

SEQ ID NO: 3934 - DNA, 19 bp, Artificial Sequence
  Description of Artificial Sequence: Chemically synthesized oligonucleotide
cactaggtagggtggcaag

SEQ ID NO: 3935 - DNA, 19 bp, Artificial Sequence
  Description of Artificial Sequence: Chemically synthesized oligonucleotide
ttgccaccctacctagtgt

SEQ ID NO: 3936 - DNA, 19 bp, Artificial Sequence
  Description of Artificial Sequence: Chemically synthesized oligonucleotide
acactaggtagggtggcaa

SEQ ID NO: 3937 - DNA, 19 bp, Artificial Sequence
  Description of Artificial Sequence: Chemically synthesized oligonucleotide
tgccaccctacctagtgtc

SEQ ID NO: 3938 - DNA, 19 bp, Artificial Sequence
  Description of Artificial Sequence: Chemically synthesized oligonucleotide
gacactaggtagggtggca

SEQ ID NO: 3939 - DNA, 19 bp, Artificial Sequence
  Description of Artificial Sequence: Chemically synthesized oligonucleotide
gccaccctacctagtgtct

SEQ ID NO: 3940 - DNA, 19 bp, Artificial Sequence
  Description of Artificial Sequence: Chemically synthesized oligonucleotide
agacactaggtagggtggc

SEQ ID NO: 3941 - DNA, 19 bp, Artificial Sequence
  Description of Artificial Sequence: Chemically synthesized oligonucleotide
ccaccctacctagtgtctg

SEQ ID NO: 3942 - DNA, 19 bp, Artificial Sequence
  Description of Artificial Sequence: Chemically synthesized oligonucleotide
cagacactaggtagggtgg

SEQ ID NO: 3943 - DNA, 19 bp, Artificial Sequence
  Description of Artificial Sequence: Chemically synthesized oligonucleotide
caccctacctagtgtctgg

SEQ ID NO: 3944 - DNA, 19 bp, Artificial Sequence
  Description of Artificial Sequence: Chemically synthesized oligonucleotide
ccagacactaggtagggtg

SEQ ID NO: 3945 - DNA, 19 bp, Artificial Sequence
  Description of Artificial Sequence: Chemically synthesized oligonucleotide
accctacctagtgtctggc

SEQ ID NO: 3946 - DNA, 19 bp, Artificial Sequence
  Description of Artificial Sequence: Chemically synthesized oligonucleotide
gccagacactaggtagggt

SEQ ID NO: 3947 - DNA, 19 bp, Artificial Sequence
  Description of Artificial Sequence: Chemically synthesized oligonucleotide
ccctacctagtgtctggcc

SEQ ID NO: 3948 - DNA, 19 bp, Artificial Sequence
  Description of Artificial Sequence: Chemically synthesized oligonucleotide
ggccagacactaggtaggg

SEQ ID NO: 3949 - DNA, 19 bp, Artificial Sequence
  Description of Artificial Sequence: Chemically synthesized oligonucleotide
cctacctagtgtctggcct

SEQ ID NO: 3950 - DNA, 19 bp, Artificial Sequence
  Description of Artificial Sequence: Chemically synthesized oligonucleotide
aggccagacactaggtagg

SEQ ID NO: 3951 - DNA, 19 bp, Artificial Sequence
  Description of Artificial Sequence: Chemically synthesized oligonucleotide
ctacctagtgtctggcctg

SEQ ID NO: 3952 - DNA, 19 bp, Artificial Sequence
  Description of Artificial Sequence: Chemically synthesized oligonucleotide
caggccagacactaggtag

SEQ ID NO: 3953 - DNA, 19 bp, Artificial Sequence
  Description of Artificial Sequence: Chemically synthesized oligonucleotide
tacctagtgtctggcctgc

SEQ ID NO: 3954 - DNA, 19 bp, Artificial Sequence
  Description of Artificial Sequence: Chemically synthesized oligonucleotide
gcaggccagacactaggta

SEQ ID NO: 3955 - DNA, 19 bp, Artificial Sequence
  Description of Artificial Sequence: Chemically synthesized oligonucleotide
acctagtgtctggcctgcc

SEQ ID NO: 3956 - DNA, 19 bp, Artificial Sequence
  Description of Artificial Sequence: Chemically synthesized oligonucleotide
ggcaggccagacactaggt

SEQ ID NO: 3957 - DNA, 19 bp, Artificial Sequence
  Description of Artificial Sequence: Chemically synthesized oligonucleotide
cctagtgtctggcctgccc

SEQ ID NO: 3958 - DNA, 19 bp, Artificial Sequence
  Description of Artificial Sequence: Chemically synthesized oligonucleotide
gggcaggccagacactagg

SEQ ID NO: 3959 - DNA, 19 bp, Artificial Sequence
  Description of Artificial Sequence: Chemically synthesized oligonucleotide
ctagtgtctggcctgcccc

SEQ ID NO: 3960 - DNA, 19 bp, Artificial Sequence
  Description of Artificial Sequence: Chemically synthesized oligonucleotide
ggggcaggccagacactag

SEQ ID NO: 3961 - DNA, 19 bp, Artificial Sequence
  Description of Artificial Sequence: Chemically synthesized oligonucleotide
tagtgtctggcctgccccc

SEQ ID NO: 3962 - DNA, 19 bp, Artificial Sequence
  Description of Artificial Sequence: Chemically synthesized oligonucleotide
gggggcaggccagacacta

SEQ ID NO: 3963 - DNA, 19 bp, Artificial Sequence
  Description of Artificial Sequence: Chemically synthesized oligonucleotide
agtgtctggcctgccccca

SEQ ID NO: 3964 - DNA, 19 bp, Artificial Sequence
  Description of Artificial Sequence: Chemically synthesized oligonucleotide
tgggggcaggccagacact

SEQ ID NO: 3965 - DNA, 19 bp, Artificial Sequence
  Description of Artificial Sequence: Chemically synthesized oligonucleotide
gtgtctggcctgcccccag

SEQ ID NO: 3966 - DNA, 19 bp, Artificial Sequence
  Description of Artificial Sequence: Chemically synthesized oligonucleotide
ctgggggcaggccagacac

SEQ ID NO: 3967 - DNA, 19 bp, Artificial Sequence
  Description of Artificial Sequence: Chemically synthesized oligonucleotide
tgtctggcctgcccccaga

SEQ ID NO: 3968 - DNA, 19 bp, Artificial Sequence
  Description of Artificial Sequence: Chemically synthesized oligonucleotide
tctgggggcaggccagaca

SEQ ID NO: 3969 - DNA, 19 bp, Artificial Sequence
  Description of Artificial Sequence: Chemically synthesized oligonucleotide
gtctggcctgcccccagag

SEQ ID NO: 3970 - DNA, 19 bp, Artificial Sequence
  Description of Artificial Sequence: Chemically synthesized oligonucleotide
ctctgggggcaggccagac

SEQ ID NO: 3971 - DNA, 19 bp, Artificial Sequence
  Description of Artificial Sequence: Chemically synthesized oligonucleotide
tctggcctgcccccagagc

SEQ ID NO: 3972 - DNA, 19 bp, Artificial Sequence
  Description of Artificial Sequence: Chemically synthesized oligonucleotide
gctctgggggcaggccaga

SEQ ID NO: 3973 - DNA, 19 bp, Artificial Sequence
  Description of Artificial Sequence: Chemically synthesized oligonucleotide
ctggcctgcccccagagca

SEQ ID NO: 3974 - DNA, 19 bp, Artificial Sequence
  Description of Artificial Sequence: Chemically synthesized oligonucleotide
tgctctgggggcaggccag

SEQ ID NO: 3975 - DNA, 19 bp, Artificial Sequence
  Description of Artificial Sequence: Chemically synthesized oligonucleotide
tggcctgcccccagagcat

SEQ ID NO: 3976 - DNA, 19 bp, Artificial Sequence
  Description of Artificial Sequence: Chemically synthesized oligonucleotide
atgctctgggggcaggcca

SEQ ID NO: 3977 - DNA, 19 bp, Artificial Sequence
  Description of Artificial Sequence: Chemically synthesized oligonucleotide
ggcctgcccccagagcatc

SEQ ID NO: 3978 - DNA, 19 bp, Artificial Sequence
  Description of Artificial Sequence: Chemically synthesized oligonucleotide
gatgctctgggggcaggcc

SEQ ID NO: 3979 - DNA, 19 bp, Artificial Sequence
  Description of Artificial Sequence: Chemically synthesized oligonucleotide
gcctgcccccagagcatcc

SEQ ID NO: 3980 - DNA, 19 bp, Artificial Sequence
  Description of Artificial Sequence: Chemically synthesized oligonucleotide
ggatgctctgggggcaggc

SEQ ID NO: 3981 - DNA, 19 bp, Artificial Sequence
  Description of Artificial Sequence: Chemically synthesized oligonucleotide
cctgcccccagagcatcca

SEQ ID NO: 3982 - DNA, 19 bp, Artificial Sequence
  Description of Artificial Sequence: Chemically synthesized oligonucleotide
tggatgctctgggggcagg

SEQ ID NO: 3983 - DNA, 19 bp, Artificial Sequence
  Description of Artificial Sequence: Chemically synthesized oligonucleotide
ctgcccccagagcatccat

SEQ ID NO: 3984 - DNA, 19 bp, Artificial Sequence
  Description of Artificial Sequence: Chemically synthesized oligonucleotide
atggatgctctgggggcag

SEQ ID NO: 3985 - DNA, 19 bp, Artificial Sequence
  Description of Artificial Sequence: Chemically synthesized oligonucleotide
tgcccccagagcatccatg

SEQ ID NO: 3986 - DNA, 19 bp, Artificial Sequence
  Description of Artificial Sequence: Chemically synthesized oligonucleotide
catggatgctctgggggca

SEQ ID NO: 3987 - DNA, 19 bp, Artificial Sequence
  Description of Artificial Sequence: Chemically synthesized oligonucleotide
gcccccagagcatccatgt

SEQ ID NO: 3988 - DNA, 19 bp, Artificial Sequence
  Description of Artificial Sequence: Chemically synthesized oligonucleotide
acatggatgctctgggggc

SEQ ID NO: 3989 - DNA, 19 bp, Artificial Sequence
  Description of Artificial Sequence: Chemically synthesized oligonucleotide
cccccagagcatccatgtg

SEQ ID NO: 3990 - DNA, 19 bp, Artificial Sequence
  Description of Artificial Sequence: Chemically synthesized oligonucleotide
cacatggatgctctggggg

SEQ ID NO: 3991 - DNA, 19 bp, Artificial Sequence
  Description of Artificial Sequence: Chemically synthesized oligonucleotide
ccccagagcatccatgtga

SEQ ID NO: 3992 - DNA, 19 bp, Artificial Sequence
  Description of Artificial Sequence: Chemically synthesized oligonucleotide
tcacatggatgctctgggg

SEQ ID NO: 3993 - DNA, 19 bp, Artificial Sequence
  Description of Artificial Sequence: Chemically synthesized oligonucleotide
cccagagcatccatgtgac

SEQ ID NO: 3994 - DNA, 19 bp, Artificial Sequence
  Description of Artificial Sequence: Chemically synthesized oligonucleotide
gtcacatggatgctctggg

SEQ ID NO: 3995 - DNA, 19 bp, Artificial Sequence
  Description of Artificial Sequence: Chemically synthesized oligonucleotide
ccagagcatccatgtgact

SEQ ID NO: 3996 - DNA, 19 bp, Artificial Sequence
  Description of Artificial Sequence: Chemically synthesized oligonucleotide
agtcacatggatgctctgg

SEQ ID NO: 3997 - DNA, 19 bp, Artificial Sequence
  Description of Artificial Sequence: Chemically synthesized oligonucleotide
cagagcatccatgtgactg

SEQ ID NO: 3998 - DNA, 19 bp, Artificial Sequence
  Description of Artificial Sequence: Chemically synthesized oligonucleotide
cagtcacatggatgctctg

SEQ ID NO: 3999 - DNA, 19 bp, Artificial Sequence
  Description of Artificial Sequence: Chemically synthesized oligonucleotide
agagcatccatgtgactgg

SEQ ID NO: 4000 - DNA, 19 bp, Artificial Sequence
  Description of Artificial Sequence: Chemically synthesized oligonucleotide
ccagtcacatggatgctct

SEQ ID NO: 4001 - DNA, 19 bp, Artificial Sequence
  Description of Artificial Sequence: Chemically synthesized oligonucleotide
gagcatccatgtgactggc

SEQ ID NO: 4002 - DNA, 19 bp, Artificial Sequence
  Description of Artificial Sequence: Chemically synthesized oligonucleotide
gccagtcacatggatgctc

SEQ ID NO: 4003 - DNA, 19 bp, Artificial Sequence
  Description of Artificial Sequence: Chemically synthesized oligonucleotide
agcatccatgtgactggcc

SEQ ID NO: 4004 - DNA, 19 bp, Artificial Sequence
  Description of Artificial Sequence: Chemically synthesized oligonucleotide
ggccagtcacatggatgct

SEQ ID NO: 4005 - DNA, 19 bp, Artificial Sequence
  Description of Artificial Sequence: Chemically synthesized oligonucleotide
gcatccatgtgactggccc

SEQ ID NO: 4006 - DNA, 19 bp, Artificial Sequence
  Description of Artificial Sequence: Chemically synthesized oligonucleotide
gggccagtcacatggatgc

SEQ ID NO: 4007 - DNA, 19 bp, Artificial Sequence
  Description of Artificial Sequence: Chemically synthesized oligonucleotide
catccatgtgactggcccc

SEQ ID NO: 4008 - DNA, 19 bp, Artificial Sequence
  Description of Artificial Sequence: Chemically synthesized oligonucleotide
ggggccagtcacatggatg

SEQ ID NO: 4009 - DNA, 19 bp, Artificial Sequence
  Description of Artificial Sequence: Chemically synthesized oligonucleotide
atccatgtgactggcccct

SEQ ID NO: 4010 - DNA, 19 bp, Artificial Sequence
  Description of Artificial Sequence: Chemically synthesized oligonucleotide
aggggccagtcacatggat

SEQ ID NO: 4011 - DNA, 19 bp, Artificial Sequence
  Description of Artificial Sequence: Chemically synthesized oligonucleotide
tccatgtgactggcccctg

SEQ ID NO: 4012 - DNA, 19 bp, Artificial Sequence
  Description of Artificial Sequence: Chemically synthesized oligonucleotide
caggggccagtcacatgga

SEQ ID NO: 4013 - DNA, 19 bp, Artificial Sequence
  Description of Artificial Sequence: Chemically synthesized oligonucleotide
ccatgtgactggcccctga

SEQ ID NO: 4014 - DNA, 19 bp, Artificial Sequence
  Description of Artificial Sequence: Chemically synthesized oligonucleotide
tcaggggccagtcacatgg

SEQ ID NO: 4015 - DNA, 19 bp, Artificial Sequence
  Description of Artificial Sequence: Chemically synthesized oligonucleotide
catgtgactggcccctgac

SEQ ID NO: 4016 - DNA, 19 bp, Artificial Sequence
  Description of Artificial Sequence: Chemically synthesized oligonucleotide
gtcaggggccagtcacatg

SEQ ID NO: 4017 - DNA, 19 bp, Artificial Sequence
  Description of Artificial Sequence: Chemically synthesized oligonucleotide
atgtgactggcccctgacc

SEQ ID NO: 4018 - DNA, 19 bp, Artificial Sequence
  Description of Artificial Sequence: Chemically synthesized oligonucleotide
ggtcaggggccagtcacat

SEQ ID NO: 4019 - DNA, 19 bp, Artificial Sequence
  Description of Artificial Sequence: Chemically synthesized oligonucleotide
tgtgactggcccctgaccc

SEQ ID NO: 4020 - DNA, 19 bp, Artificial Sequence
  Description of Artificial Sequence: Chemically synthesized oligonucleotide
gggtcaggggccagtcaca

SEQ ID NO: 4021 - DNA, 19 bp, Artificial Sequence
  Description of Artificial Sequence: Chemically synthesized oligonucleotide
gtgactggcccctgacccc

SEQ ID NO: 4022 - DNA, 19 bp, Artificial Sequence
  Description of Artificial Sequence: Chemically synthesized oligonucleotide
ggggtcaggggccagtcac

SEQ ID NO: 4023 - DNA, 19 bp, Artificial Sequence
  Description of Artificial Sequence: Chemically synthesized oligonucleotide
tgactggcccctgaccccg

SEQ ID NO: 4024 - DNA, 19 bp, Artificial Sequence
  Description of Artificial Sequence: Chemically synthesized oligonucleotide
cggggtcaggggccagtca

SEQ ID NO: 4025 - DNA, 19 bp, Artificial Sequence
  Description of Artificial Sequence: Chemically synthesized oligonucleotide
gactggcccctgaccccgc

SEQ ID NO: 4026 - DNA, 19 bp, Artificial Sequence
  Description of Artificial Sequence: Chemically synthesized oligonucleotide
gcggggtcaggggccagtc

SEQ ID NO: 4027 - DNA, 19 bp, Artificial Sequence
  Description of Artificial Sequence: Chemically synthesized oligonucleotide
actggcccctgaccccgca

SEQ ID NO: 4028 - DNA, 19 bp, Artificial Sequence
  Description of Artificial Sequence: Chemically synthesized oligonucleotide
tgcggggtcaggggccagt

SEQ ID NO: 4029 - DNA, 19 bp, Artificial Sequence
  Description of Artificial Sequence: Chemically synthesized oligonucleotide
ctggcccctgaccccgcac

SEQ ID NO: 4030 - DNA, 19 bp, Artificial Sequence
  Description of Artificial Sequence: Chemically synthesized oligonucleotide
gtgcggggtcaggggccag

SEQ ID NO: 4031 - DNA, 19 bp, Artificial Sequence
  Description of Artificial Sequence: Chemically synthesized oligonucleotide
tggcccctgaccccgcacc

SEQ ID NO: 4032 - DNA, 19 bp, Artificial Sequence
  Description of Artificial Sequence: Chemically synthesized oligonucleotide
ggtgcggggtcaggggcca

SEQ ID NO: 4033 - DNA, 19 bp, Artificial Sequence
  Description of Artificial Sequence: Chemically synthesized oligonucleotide
ggcccctgaccccgcaccc

SEQ ID NO: 4034 - DNA, 19 bp, Artificial Sequence
  Description of Artificial Sequence: Chemically synthesized oligonucleotide
gggtgcggggtcaggggcc

SEQ ID NO: 4035 - DNA, 19 bp, Artificial Sequence
  Description of Artificial Sequence: Chemically synthesized oligonucleotide
gcccctgaccccgcacccc

SEQ ID NO: 4036 - DNA, 19 bp, Artificial Sequence
  Description of Artificial Sequence: Chemically synthesized oligonucleotide
ggggtgcggggtcaggggc

SEQ ID NO: 4037 - DNA, 19 bp, Artificial Sequence
  Description of Artificial Sequence: Chemically synthesized oligonucleotide
cccctgaccccgcacccct

SEQ ID NO: 4038 - DNA, 19 bp, Artificial Sequence
  Description of Artificial Sequence: Chemically synthesized oligonucleotide
aggggtgcggggtcagggg

SEQ ID NO: 4039 - DNA, 19 bp, Artificial Sequence
  Description of Artificial Sequence: Chemically synthesized oligonucleotide
ccctgaccccgcacccctg

SEQ ID NO: 4040 - DNA, 19 bp, Artificial Sequence
  Description of Artificial Sequence: Chemically synthesized oligonucleotide
caggggtgcggggtcaggg

SEQ ID NO: 4041 - DNA, 19 bp, Artificial Sequence
  Description of Artificial Sequence: Chemically synthesized oligonucleotide
cctgaccccgcacccctgg

SEQ ID NO: 4042 - DNA, 19 bp, Artificial Sequence
  Description of Artificial Sequence: Chemically synthesized oligonucleotide
ccaggggtgcggggtcagg

SEQ ID NO: 4043 - DNA, 19 bp, Artificial Sequence
  Description of Artificial Sequence: Chemically synthesized oligonucleotide
ctgaccccgcacccctggg

SEQ ID NO: 4044 - DNA, 19 bp, Artificial Sequence
  Description of Artificial Sequence: Chemically synthesized oligonucleotide
cccaggggtgcggggtcag

SEQ ID NO: 4045 - DNA, 19 bp, Artificial Sequence
  Description of Artificial Sequence: Chemically synthesized oligonucleotide
tgaccccgcacccctgggt

SEQ ID NO: 4046 - DNA, 19 bp, Artificial Sequence
  Description of Artificial Sequence: Chemically synthesized oligonucleotide
acccaggggtgcggggtca

SEQ ID NO: 4047 - DNA, 19 bp, Artificial Sequence
  Description of Artificial Sequence: Chemically synthesized oligonucleotide
gaccccgcacccctgggta

SEQ ID NO: 4048 - DNA, 19 bp, Artificial Sequence
  Description of Artificial Sequence: Chemically synthesized oligonucleotide
tacccaggggtgcggggtc

SEQ ID NO: 4049 - DNA, 19 bp, Artificial Sequence
  Description of Artificial Sequence: Chemically synthesized oligonucleotide
accccgcacccctgggtat

SEQ ID NO: 4050 - DNA, 19 bp, Artificial Sequence
  Description of Artificial Sequence: Chemically synthesized oligonucleotide
atacccaggggtgcggggt

SEQ ID NO: 4051 - DNA, 19 bp, Artificial Sequence
  Description of Artificial Sequence: Chemically synthesized oligonucleotide
ccccgcacccctgggtata

SEQ ID NO: 4052 - DNA, 19 bp, Artificial Sequence
  Description of Artificial Sequence: Chemically synthesized oligonucleotide
tatacccaggggtgcgggg

SEQ ID NO: 4053 - DNA, 19 bp, Artificial Sequence
  Description of Artificial Sequence: Chemically synthesized oligonucleotide
cccgcacccctgggtatac

SEQ ID NO: 4054 - DNA, 19 bp, Artificial Sequence
  Description of Artificial Sequence: Chemically synthesized oligonucleotide
gtatacccaggggtgcggg

SEQ ID NO: 4055 - DNA, 19 bp, Artificial Sequence
  Description of Artificial Sequence: Chemically synthesized oligonucleotide
ccgcacccctgggtatact

SEQ ID NO: 4056 - DNA, 19 bp, Artificial Sequence
  Description of Artificial Sequence: Chemically synthesized oligonucleotide
agtatacccaggggtgcgg

SEQ ID NO: 4057 - DNA, 19 bp, Artificial Sequence
  Description of Artificial Sequence: Chemically synthesized oligonucleotide
cgcacccctgggtatactc

SEQ ID NO: 4058 - DNA, 19 bp, Artificial Sequence
  Description of Artificial Sequence: Chemically synthesized oligonucleotide
gagtatacccaggggtgcg

SEQ ID NO: 4059 - DNA, 19 bp, Artificial Sequence
  Description of Artificial Sequence: Chemically synthesized oligonucleotide
gcacccctgggtatactcc

SEQ ID NO: 4060 - DNA, 19 bp, Artificial Sequence
  Description of Artificial Sequence: Chemically synthesized oligonucleotide
ggagtatacccaggggtgc

SEQ ID NO: 4061 - DNA, 19 bp, Artificial Sequence
  Description of Artificial Sequence: Chemically synthesized oligonucleotide
cacccctgggtatactccg

SEQ ID NO: 4062 - DNA, 19 bp, Artificial Sequence
  Description of Artificial Sequence: Chemically synthesized oligonucleotide
cggagtatacccaggggtg

SEQ ID NO: 4063 - DNA, 19 bp, Artificial Sequence
  Description of Artificial Sequence: Chemically synthesized oligonucleotide
acccctgggtatactccgg

SEQ ID NO: 4064 - DNA, 19 bp, Artificial Sequence
  Description of Artificial Sequence: Chemically synthesized oligonucleotide
ccggagtatacccaggggt

SEQ ID NO: 4065 - DNA, 19 bp, Artificial Sequence
  Description of Artificial Sequence: Chemically synthesized oligonucleotide
cccctgggtatactccggg

SEQ ID NO: 4066 - DNA, 19 bp, Artificial Sequence
  Description of Artificial Sequence: Chemically synthesized oligonucleotide
cccggagtatacccagggg

SEQ ID NO: 4067 - DNA, 19 bp, Artificial Sequence
  Description of Artificial Sequence: Chemically synthesized oligonucleotide
ccctgggtatactccgggg

SEQ ID NO: 4068 - DNA, 19 bp, Artificial Sequence
  Description of Artificial Sequence: Chemically synthesized oligonucleotide
ccccggagtatacccaggg

SEQ ID NO: 4069 - DNA, 19 bp, Artificial Sequence
  Description of Artificial Sequence: Chemically synthesized oligonucleotide
cctgggtatactccggggg

SEQ ID NO: 4070 - DNA, 19 bp, Artificial Sequence
  Description of Artificial Sequence: Chemically synthesized oligonucleotide
cccccggagtatacccagg

SEQ ID NO: 4071 - DNA, 19 bp, Artificial Sequence
  Description of Artificial Sequence: Chemically synthesized oligonucleotide
ctgggtatactccgggggc

SEQ ID NO: 4072 - DNA, 19 bp, Artificial Sequence
  Description of Artificial Sequence: Chemically synthesized oligonucleotide
gcccccggagtatacccag

SEQ ID NO: 4073 - DNA, 19 bp, Artificial Sequence
  Description of Artificial Sequence: Chemically synthesized oligonucleotide
tgggtatactccgggggcc

SEQ ID NO: 4074 - DNA, 19 bp, Artificial Sequence
  Description of Artificial Sequence: Chemically synthesized oligonucleotide
ggcccccggagtataccca

SEQ ID NO: 4075 - DNA, 19 bp, Artificial Sequence
  Description of Artificial Sequence: Chemically synthesized oligonucleotide
gggtatactccgggggcca

SEQ ID NO: 4076 - DNA, 19 bp, Artificial Sequence
  Description of Artificial Sequence: Chemically synthesized oligonucleotide
tggcccccggagtataccc

SEQ ID NO: 4077 - DNA, 19 bp, Artificial Sequence
  Description of Artificial Sequence: Chemically synthesized oligonucleotide
ggtatactccgggggccag

SEQ ID NO: 4078 - DNA, 19 bp, Artificial Sequence
  Description of Artificial Sequence: Chemically synthesized oligonucleotide
ctggcccccggagtatacc

SEQ ID NO: 4079 - DNA, 19 bp, Artificial Sequence
  Description of Artificial Sequence: Chemically synthesized oligonucleotide
gtatactccgggggccagc

SEQ ID NO: 4080 - DNA, 19 bp, Artificial Sequence
  Description of Artificial Sequence: Chemically synthesized oligonucleotide
gctggcccccggagtatac

SEQ ID NO: 4081 - DNA, 19 bp, Artificial Sequence
  Description of Artificial Sequence: Chemically synthesized oligonucleotide
tatactccgggggccagcc

SEQ ID NO: 4082 - DNA, 19 bp, Artificial Sequence
  Description of Artificial Sequence: Chemically synthesized oligonucleotide
ggctggcccccggagtata

SEQ ID NO: 4083 - DNA, 19 bp, Artificial Sequence
  Description of Artificial Sequence: Chemically synthesized oligonucleotide
atactccgggggccagccc

SEQ ID NO: 4084 - DNA, 19 bp, Artificial Sequence
  Description of Artificial Sequence: Chemically synthesized oligonucleotide
gggctggcccccggagtat

SEQ ID NO: 4085 - DNA, 19 bp, Artificial Sequence
  Description of Artificial Sequence: Chemically synthesized oligonucleotide
tactccgggggccagccca

SEQ ID NO: 4086 - DNA, 19 bp, Artificial Sequence
  Description of Artificial Sequence: Chemically synthesized oligonucleotide
tgggctggcccccggagta

SEQ ID NO: 4087 - DNA, 19 bp, Artificial Sequence
  Description of Artificial Sequence: Chemically synthesized oligonucleotide
actccgggggccagcccaa

SEQ ID NO: 4088 - DNA, 19 bp, Artificial Sequence
  Description of Artificial Sequence: Chemically synthesized oligonucleotide
ttgggctggcccccggagt

SEQ ID NO: 4089 - DNA, 19 bp, Artificial Sequence
  Description of Artificial Sequence: Chemically synthesized oligonucleotide
ctccgggggccagcccaaa

SEQ ID NO: 4090 - DNA, 19 bp, Artificial Sequence
  Description of Artificial Sequence: Chemically synthesized oligonucleotide
tttgggctggcccccggag

SEQ ID NO: 4091 - DNA, 19 bp, Artificial Sequence
  Description of Artificial Sequence: Chemically synthesized oligonucleotide
tccgggggccagcccaaag

SEQ ID NO: 4092 - DNA, 19 bp, Artificial Sequence
  Description of Artificial Sequence: Chemically synthesized oligonucleotide
ctttgggctggcccccgga

SEQ ID NO: 4093 - DNA, 19 bp, Artificial Sequence
  Description of Artificial Sequence: Chemically synthesized oligonucleotide
ccgggggccagcccaaagt

SEQ ID NO: 4094 - DNA, 19 bp, Artificial Sequence
  Description of Artificial Sequence: Chemically synthesized oligonucleotide
actttgggctggcccccgg

SEQ ID NO: 4095 - DNA, 19 bp, Artificial Sequence
  Description of Artificial Sequence: Chemically synthesized oligonucleotide
cgggggccagcccaaagtg

SEQ ID NO: 4096 - DNA, 19 bp, Artificial Sequence
  Description of Artificial Sequence: Chemically synthesized oligonucleotide
cactttgggctggcccccg

SEQ ID NO: 4097 - DNA, 19 bp, Artificial Sequence
  Description of Artificial Sequence: Chemically synthesized oligonucleotide
gggggccagcccaaagtgc

SEQ ID NO: 4098 - DNA, 19 bp, Artificial Sequence
  Description of Artificial Sequence: Chemically synthesized oligonucleotide
gcactttgggctggccccc

SEQ ID NO: 4099 - DNA, 19 bp, Artificial Sequence
  Description of Artificial Sequence: Chemically synthesized oligonucleotide
ggggccagcccaaagtgcc

SEQ ID NO: 4100 - DNA, 19 bp, Artificial Sequence
  Description of Artificial Sequence: Chemically synthesized oligonucleotide
ggcactttgggctggcccc

SEQ ID NO: 4101 - DNA, 19 bp, Artificial Sequence
  Description of Artificial Sequence: Chemically synthesized oligonucleotide
gggccagcccaaagtgccc

SEQ ID NO: 4102 - DNA, 19 bp, Artificial Sequence
  Description of Artificial Sequence: Chemically synthesized oligonucleotide
gggcactttgggctggccc

SEQ ID NO: 4103 - DNA, 19 bp, Artificial Sequence
  Description of Artificial Sequence: Chemically synthesized oligonucleotide
ggccagcccaaagtgccct

SEQ ID NO: 4104 - DNA, 19 bp, Artificial Sequence
  Description of Artificial Sequence: Chemically synthesized oligonucleotide
agggcactttgggctggcc

SEQ ID NO: 4105 - DNA, 19 bp, Artificial Sequence
  Description of Artificial Sequence: Chemically synthesized oligonucleotide
gccagcccaaagtgccctc

SEQ ID NO: 4106 - DNA, 19 bp, Artificial Sequence
  Description of Artificial Sequence: Chemically synthesized oligonucleotide
gagggcactttgggctggc

SEQ ID NO: 4107 - DNA, 19 bp, Artificial Sequence
  Description of Artificial Sequence: Chemically synthesized oligonucleotide
ccagcccaaagtgccctct

SEQ ID NO: 4108 - DNA, 19 bp, Artificial Sequence
  Description of Artificial Sequence: Chemically synthesized oligonucleotide
agagggcactttgggctgg

SEQ ID NO: 4109 - DNA, 19 bp, Artificial Sequence
  Description of Artificial Sequence: Chemically synthesized oligonucleotide
cagcccaaagtgccctctg

SEQ ID NO: 4110 - DNA, 19 bp, Artificial Sequence
  Description of Artificial Sequence: Chemically synthesized oligonucleotide
cagagggcactttgggctg

SEQ ID NO: 4111 - DNA, 19 bp, Artificial Sequence
  Description of Artificial Sequence: Chemically synthesized oligonucleotide
agcccaaagtgccctctgc

SEQ ID NO: 4112 - DNA, 19 bp, Artificial Sequence
  Description of Artificial Sequence: Chemically synthesized oligonucleotide
gcagagggcactttgggct

SEQ ID NO: 4113 - DNA, 19 bp, Artificial Sequence
  Description of Artificial Sequence: Chemically synthesized oligonucleotide
gcccaaagtgccctctgcc

SEQ ID NO: 4114 - DNA, 19 bp, Artificial Sequence
  Description of Artificial Sequence: Chemically synthesized oligonucleotide
ggcagagggcactttgggc

SEQ ID NO: 4115 - DNA, 19 bp, Artificial Sequence
  Description of Artificial Sequence: Chemically synthesized oligonucleotide
cccaaagtgccctctgcct

SEQ ID NO: 4116 - DNA, 19 bp, Artificial Sequence
  Description of Artificial Sequence: Chemically synthesized oligonucleotide
aggcagagggcactttggg

SEQ ID NO: 4117 - DNA, 19 bp, Artificial Sequence
  Description of Artificial Sequence: Chemically synthesized oligonucleotide
ccaaagtgccctctgcctt

SEQ ID NO: 4118 - DNA, 19 bp, Artificial Sequence
  Description of Artificial Sequence: Chemically synthesized oligonucleotide
aaggcagagggcactttgg

SEQ ID NO: 4119 - DNA, 19 bp, Artificial Sequence
  Description of Artificial Sequence: Chemically synthesized oligonucleotide
caaagtgccctctgccttc

SEQ ID NO: 4120 - DNA, 19 bp, Artificial Sequence
  Description of Artificial Sequence: Chemically synthesized oligonucleotide
gaaggcagagggcactttg

SEQ ID NO: 4121 - DNA, 19 bp, Artificial Sequence
  Description of Artificial Sequence: Chemically synthesized oligonucleotide
aaagtgccctctgccttca

SEQ ID NO: 4122 - DNA, 19 bp, Artificial Sequence
  Description of Artificial Sequence: Chemically synthesized oligonucleotide
tgaaggcagagggcacttt

SEQ ID NO: 4123 - DNA, 19 bp, Artificial Sequence
  Description of Artificial Sequence: Chemically synthesized oligonucleotide
aagtgccctctgccttcag

SEQ ID NO: 4124 - DNA, 19 bp, Artificial Sequence
  Description of Artificial Sequence: Chemically synthesized oligonucleotide
ctgaaggcagagggcactt

SEQ ID NO: 4125 - DNA, 19 bp, Artificial Sequence
  Description of Artificial Sequence: Chemically synthesized oligonucleotide
agtgccctctgccttcagc

SEQ ID NO: 4126 - DNA, 19 bp, Artificial Sequence
  Description of Artificial Sequence: Chemically synthesized oligonucleotide
gctgaaggcagagggcact

SEQ ID NO: 4127 - DNA, 19 bp, Artificial Sequence
  Description of Artificial Sequence: Chemically synthesized oligonucleotide
gtgccctctgccttcagct

SEQ ID NO: 4128 - DNA, 19 bp, Artificial Sequence
  Description of Artificial Sequence: Chemically synthesized oligonucleotide
agctgaaggcagagggcac

SEQ ID NO: 4129 - DNA, 19 bp, Artificial Sequence
  Description of Artificial Sequence: Chemically synthesized oligonucleotide
tgccctctgccttcagctt

SEQ ID NO: 4130 - DNA, 19 bp, Artificial Sequence
  Description of Artificial Sequence: Chemically synthesized oligonucleotide
aagctgaaggcagagggca

SEQ ID NO: 4131 - DNA, 19 bp, Artificial Sequence
  Description of Artificial Sequence: Chemically synthesized oligonucleotide
gccctctgccttcagctta

SEQ ID NO: 4132 - DNA, 19 bp, Artificial Sequence
  Description of Artificial Sequence: Chemically synthesized oligonucleotide
taagctgaaggcagagggc

SEQ ID NO: 4133 - DNA, 19 bp, Artificial Sequence
  Description of Artificial Sequence: Chemically synthesized oligonucleotide
ccctctgccttcagcttag

SEQ ID NO: 4134 - DNA, 19 bp, Artificial Sequence
  Description of Artificial Sequence: Chemically synthesized oligonucleotide
ctaagctgaaggcagaggg

SEQ ID NO: 4135 - DNA, 19 bp, Artificial Sequence
  Description of Artificial Sequence: Chemically synthesized oligonucleotide
cctctgccttcagcttagg

SEQ ID NO: 4136 - DNA, 19 bp, Artificial Sequence
  Description of Artificial Sequence: Chemically synthesized oligonucleotide
cctaagctgaaggcagagg

SEQ ID NO: 4137 - DNA, 19 bp, Artificial Sequence
  Description of Artificial Sequence: Chemically synthesized oligonucleotide
ctctgccttcagcttaggc

SEQ ID NO: 4138 - DNA, 19 bp, Artificial Sequence
  Description of Artificial Sequence: Chemically synthesized oligonucleotide
gcctaagctgaaggcagag

SEQ ID NO: 4139 - DNA, 19 bp, Artificial Sequence
  Description of Artificial Sequence: Chemically synthesized oligonucleotide
tctgccttcagcttaggca

SEQ ID NO: 4140 - DNA, 19 bp, Artificial Sequence
  Description of Artificial Sequence: Chemically synthesized oligonucleotide
tgcctaagctgaaggcaga

SEQ ID NO: 4141 - DNA, 19 bp, Artificial Sequence
  Description of Artificial Sequence: Chemically synthesized oligonucleotide
ctgccttcagcttaggcag

SEQ ID NO: 4142 - DNA, 19 bp, Artificial Sequence
  Description of Artificial Sequence: Chemically synthesized oligonucleotide
ctgcctaagctgaaggcag

SEQ ID NO: 4143 - DNA, 19 bp, Artificial Sequence
  Description of Artificial Sequence: Chemically synthesized oligonucleotide
tgccttcagcttaggcagc

SEQ ID NO: 4144 - DNA, 19 bp, Artificial Sequence
  Description of Artificial Sequence: Chemically synthesized oligonucleotide
gctgcctaagctgaaggca

SEQ ID NO: 4145 - DNA, 19 bp, Artificial Sequence
  Description of Artificial Sequence: Chemically synthesized oligonucleotide
gccttcagcttaggcagca

SEQ ID NO: 4146 - DNA, 19 bp, Artificial Sequence
  Description of Artificial Sequence: Chemically synthesized oligonucleotide
tgctgcctaagctgaaggc

SEQ ID NO: 4147 - DNA, 19 bp, Artificial Sequence
  Description of Artificial Sequence: Chemically synthesized oligonucleotide
ccttcagcttaggcagcaa

SEQ ID NO: 4148 - DNA, 19 bp, Artificial Sequence
  Description of Artificial Sequence: Chemically synthesized oligonucleotide
ttgctgcctaagctgaagg

SEQ ID NO: 4149 - DNA, 19 bp, Artificial Sequence
  Description of Artificial Sequence: Chemically synthesized oligonucleotide
cttcagcttaggcagcaag

SEQ ID NO: 4150 - DNA, 19 bp, Artificial Sequence
  Description of Artificial Sequence: Chemically synthesized oligonucleotide
cttgctgcctaagctgaag

SEQ ID NO: 4151 - DNA, 19 bp, Artificial Sequence
  Description of Artificial Sequence: Chemically synthesized oligonucleotide
ttcagcttaggcagcaagg

SEQ ID NO: 4152 - DNA, 19 bp, Artificial Sequence
  Description of Artificial Sequence: Chemically synthesized oligonucleotide
ccttgctgcctaagctgaa

SEQ ID NO: 4153 - DNA, 19 bp, Artificial Sequence
  Description of Artificial Sequence: Chemically synthesized oligonucleotide
tcagcttaggcagcaaggg

SEQ ID NO: 4154 - DNA, 19 bp, Artificial Sequence
  Description of Artificial Sequence: Chemically synthesized oligonucleotide
cccttgctgcctaagctga

SEQ ID NO: 4155 - DNA, 19 bp, Artificial Sequence
  Description of Artificial Sequence: Chemically synthesized oligonucleotide
cagcttaggcagcaagggc

SEQ ID NO: 4156 - DNA, 19 bp, Artificial Sequence
  Description of Artificial Sequence: Chemically synthesized oligonucleotide
gcccttgctgcctaagctg

SEQ ID NO: 4157 - DNA, 19 bp, Artificial Sequence
  Description of Artificial Sequence: Chemically synthesized oligonucleotide
agcttaggcagcaagggct

SEQ ID NO: 4158 - DNA, 19 bp, Artificial Sequence
  Description of Artificial Sequence: Chemically synthesized oligonucleotide
agcccttgctgcctaagct

SEQ ID NO: 4159 - DNA, 19 bp, Artificial Sequence
  Description of Artificial Sequence: Chemically synthesized oligonucleotide
gcttaggcagcaagggctt

SEQ ID NO: 4160 - DNA, 19 bp, Artificial Sequence
  Description of Artificial Sequence: Chemically synthesized oligonucleotide
aagcccttgctgcctaagc

SEQ ID NO: 4161 - DNA, 19 bp, Artificial Sequence
  Description of Artificial Sequence: Chemically synthesized oligonucleotide
cttaggcagcaagggcttt

SEQ ID NO: 4162 - DNA, 19 bp, Artificial Sequence
  Description of Artificial Sequence: Chemically synthesized oligonucleotide
aaagcccttgctgcctaag

SEQ ID NO: 4163 - DNA, 19 bp, Artificial Sequence
  Description of Artificial Sequence: Chemically synthesized oligonucleotide
ttaggcagcaagggctttt

SEQ ID NO: 4164 - DNA, 19 bp, Artificial Sequence
  Description of Artificial Sequence: Chemically synthesized oligonucleotide
aaaagcccttgctgcctaa

SEQ ID NO: 4165 - DNA, 19 bp, Artificial Sequence
  Description of Artificial Sequence: Chemically synthesized oligonucleotide
taggcagcaagggctttta

SEQ ID NO: 4166 - DNA, 19 bp, Artificial Sequence
  Description of Artificial Sequence: Chemically synthesized oligonucleotide
taaaagcccttgctgccta

SEQ ID NO: 4167 - DNA, 19 bp, Artificial Sequence
  Description of Artificial Sequence: Chemically synthesized oligonucleotide
aggcagcaagggcttttac

SEQ ID NO: 4168 - DNA, 19 bp, Artificial Sequence
  Description of Artificial Sequence: Chemically synthesized oligonucleotide
gtaaaagcccttgctgcct

SEQ ID NO: 4169 - DNA, 19 bp, Artificial Sequence
  Description of Artificial Sequence: Chemically synthesized oligonucleotide
ggcagcaagggcttttact

SEQ ID NO: 4170 - DNA, 19 bp, Artificial Sequence
  Description of Artificial Sequence: Chemically synthesized oligonucleotide
agtaaaagcccttgctgcc

SEQ ID NO: 4171 - DNA, 19 bp, Artificial Sequence
  Description of Artificial Sequence: Chemically synthesized oligonucleotide
gcagcaagggcttttacta

SEQ ID NO: 4172 - DNA, 19 bp, Artificial Sequence
  Description of Artificial Sequence: Chemically synthesized oligonucleotide
tagtaaaagcccttgctgc

SEQ ID NO: 4173 - DNA, 19 bp, Artificial Sequence
  Description of Artificial Sequence: Chemically synthesized oligonucleotide
cagcaagggcttttactac

SEQ ID NO: 4174 - DNA, 19 bp, Artificial Sequence
  Description of Artificial Sequence: Chemically synthesized oligonucleotide
gtagtaaaagcccttgctg

SEQ ID NO: 4175 - DNA, 19 bp, Artificial Sequence
  Description of Artificial Sequence: Chemically synthesized oligonucleotide
agcaagggcttttactaca

SEQ ID NO: 4176 - DNA, 19 bp, Artificial Sequence
  Description of Artificial Sequence: Chemically synthesized oligonucleotide
tgtagtaaaagcccttgct

SEQ ID NO: 4177 - DNA, 19 bp, Artificial Sequence
  Description of Artificial Sequence: Chemically synthesized oligonucleotide
gcaagggcttttactacaa

SEQ ID NO: 4178 - DNA, 19 bp, Artificial Sequence
  Description of Artificial Sequence: Chemically synthesized oligonucleotide
ttgtagtaaaagcccttgc

SEQ ID NO: 4179 - DNA, 19 bp, Artificial Sequence
  Description of Artificial Sequence: Chemically synthesized oligonucleotide
caagggcttttactacaag

SEQ ID NO: 4180 - DNA, 19 bp, Artificial Sequence
  Description of Artificial Sequence: Chemically synthesized oligonucleotide
cttgtagtaaaagcccttg

SEQ ID NO: 4181 - DNA, 19 bp, Artificial Sequence
  Description of Artificial Sequence: Chemically synthesized oligonucleotide
aagggcttttactacaagg

SEQ ID NO: 4182 - DNA, 19 bp, Artificial Sequence
  Description of Artificial Sequence: Chemically synthesized oligonucleotide
ccttgtagtaaaagccctt

SEQ ID NO: 4183 - DNA, 19 bp, Artificial Sequence
  Description of Artificial Sequence: Chemically synthesized oligonucleotide
agggcttttactacaagga

SEQ ID NO: 4184 - DNA, 19 bp, Artificial Sequence
  Description of Artificial Sequence: Chemically synthesized oligonucleotide
tccttgtagtaaaagccct

SEQ ID NO: 4185 - DNA, 19 bp, Artificial Sequence
  Description of Artificial Sequence: Chemically synthesized oligonucleotide
gggcttttactacaaggat

SEQ ID NO: 4186 - DNA, 19 bp, Artificial Sequence
  Description of Artificial Sequence: Chemically synthesized oligonucleotide
atccttgtagtaaaagccc

SEQ ID NO: 4187 - DNA, 19 bp, Artificial Sequence
  Description of Artificial Sequence: Chemically synthesized oligonucleotide
ggcttttactacaaggatc

SEQ ID NO: 4188 - DNA, 19 bp, Artificial Sequence
  Description of Artificial Sequence: Chemically synthesized oligonucleotide
gatccttgtagtaaaagcc

SEQ ID NO: 4189 - DNA, 19 bp, Artificial Sequence
  Description of Artificial Sequence: Chemically synthesized oligonucleotide
gcttttactacaaggatcc

SEQ ID NO: 4190 - DNA, 19 bp, Artificial Sequence
  Description of Artificial Sequence: Chemically synthesized oligonucleotide
ggatccttgtagtaaaagc

SEQ ID NO: 4191 - DNA, 19 bp, Artificial Sequence
  Description of Artificial Sequence: Chemically synthesized oligonucleotide
cttttactacaaggatccg

SEQ ID NO: 4192 - DNA, 19 bp, Artificial Sequence
  Description of Artificial Sequence: Chemically synthesized oligonucleotide
cggatccttgtagtaaaag

SEQ ID NO: 4193 - DNA, 19 bp, Artificial Sequence
  Description of Artificial Sequence: Chemically synthesized oligonucleotide
ttttactacaaggatccga

SEQ ID NO: 4194 - DNA, 19 bp, Artificial Sequence
  Description of Artificial Sequence: Chemically synthesized oligonucleotide
tcggatccttgtagtaaaa

SEQ ID NO: 4195 - DNA, 19 bp, Artificial Sequence
  Description of Artificial Sequence: Chemically synthesized oligonucleotide
tttactacaaggatccgag

SEQ ID NO: 4196 - DNA, 19 bp, Artificial Sequence
  Description of Artificial Sequence: Chemically synthesized oligonucleotide
ctcggatccttgtagtaaa

SEQ ID NO: 4197 - DNA, 19 bp, Artificial Sequence
  Description of Artificial Sequence: Chemically synthesized oligonucleotide
ttactacaaggatccgagc

SEQ ID NO: 4198 - DNA, 19 bp, Artificial Sequence
  Description of Artificial Sequence: Chemically synthesized oligonucleotide
gctcggatccttgtagtaa

SEQ ID NO: 4199 - DNA, 19 bp, Artificial Sequence
  Description of Artificial Sequence: Chemically synthesized oligonucleotide
tactacaaggatccgagca

SEQ ID NO: 4200 - DNA, 19 bp, Artificial Sequence
  Description of Artificial Sequence: Chemically synthesized oligonucleotide
tgctcggatccttgtagta

SEQ ID NO: 4201 - DNA, 19 bp, Artificial Sequence
  Description of Artificial Sequence: Chemically synthesized oligonucleotide
actacaaggatccgagcat

SEQ ID NO: 4202 - DNA, 19 bp, Artificial Sequence
  Description of Artificial Sequence: Chemically synthesized oligonucleotide
atgctcggatccttgtagt

SEQ ID NO: 4203 - DNA, 19 bp, Artificial Sequence
  Description of Artificial Sequence: Chemically synthesized oligonucleotide
ctacaaggatccgagcatt

SEQ ID NO: 4204 - DNA, 19 bp, Artificial Sequence
  Description of Artificial Sequence: Chemically synthesized oligonucleotide
aatgctcggatccttgtag

SEQ ID NO: 4205 - DNA, 19 bp, Artificial Sequence
  Description of Artificial Sequence: Chemically synthesized oligonucleotide
tacaaggatccgagcattc

SEQ ID NO: 4206 - DNA, 19 bp, Artificial Sequence
  Description of Artificial Sequence: Chemically synthesized oligonucleotide
gaatgctcggatccttgta

SEQ ID NO: 4207 - DNA, 19 bp, Artificial Sequence
  Description of Artificial Sequence: Chemically synthesized oligonucleotide
acaaggatccgagcattcc

SEQ ID NO: 4208 - DNA, 19 bp, Artificial Sequence
  Description of Artificial Sequence: Chemically synthesized oligonucleotide
ggaatgctcggatccttgt

SEQ ID NO: 4209 - DNA, 19 bp, Artificial Sequence
  Description of Artificial Sequence: Chemically synthesized oligonucleotide
caaggatccgagcattccc

SEQ ID NO: 4210 - DNA, 19 bp, Artificial Sequence
  Description of Artificial Sequence: Chemically synthesized oligonucleotide
gggaatgctcggatccttg

SEQ ID NO: 4211 - DNA, 19 bp, Artificial Sequence
  Description of Artificial Sequence: Chemically synthesized oligonucleotide
aaggatccgagcattccca

SEQ ID NO: 4212 - DNA, 19 bp, Artificial Sequence
  Description of Artificial Sequence: Chemically synthesized oligonucleotide
tgggaatgctcggatcctt

SEQ ID NO: 4213 - DNA, 19 bp, Artificial Sequence
  Description of Artificial Sequence: Chemically synthesized oligonucleotide
aggatccgagcattcccag

SEQ ID NO: 4214 - DNA, 19 bp, Artificial Sequence
  Description of Artificial Sequence: Chemically synthesized oligonucleotide
ctgggaatgctcggatcct

SEQ ID NO: 4215 - DNA, 19 bp, Artificial Sequence
  Description of Artificial Sequence: Chemically synthesized oligonucleotide
ggatccgagcattcccagg

SEQ ID NO: 4216 - DNA, 19 bp, Artificial Sequence
  Description of Artificial Sequence: Chemically synthesized oligonucleotide
cctgggaatgctcggatcc

SEQ ID NO: 4217 - DNA, 19 bp, Artificial Sequence
  Description of Artificial Sequence: Chemically synthesized oligonucleotide
gatccgagcattcccaggt

SEQ ID NO: 4218 - DNA, 19 bp, Artificial Sequence
  Description of Artificial Sequence: Chemically synthesized oligonucleotide
acctgggaatgctcggatc

SEQ ID NO: 4219 - DNA, 19 bp, Artificial Sequence
  Description of Artificial Sequence: Chemically synthesized oligonucleotide
atccgagcattcccaggtt

SEQ ID NO: 4220 - DNA, 19 bp, Artificial Sequence
  Description of Artificial Sequence: Chemically synthesized oligonucleotide
aacctgggaatgctcggat

SEQ ID NO: 4221 - DNA, 19 bp, Artificial Sequence
  Description of Artificial Sequence: Chemically synthesized oligonucleotide
tccgagcattcccaggttg

SEQ ID NO: 4222 - DNA, 19 bp, Artificial Sequence
  Description of Artificial Sequence: Chemically synthesized oligonucleotide
caacctgggaatgctcgga

SEQ ID NO: 4223 - DNA, 19 bp, Artificial Sequence
  Description of Artificial Sequence: Chemically synthesized oligonucleotide
ccgagcattcccaggttgg

SEQ ID NO: 4224 - DNA, 19 bp, Artificial Sequence
  Description of Artificial Sequence: Chemically synthesized oligonucleotide
ccaacctgggaatgctcgg

SEQ ID NO: 4225 - DNA, 19 bp, Artificial Sequence
  Description of Artificial Sequence: Chemically synthesized oligonucleotide
cgagcattcccaggttggc

SEQ ID NO: 4226 - DNA, 19 bp, Artificial Sequence
  Description of Artificial Sequence: Chemically synthesized oligonucleotide
gccaacctgggaatgctcg

SEQ ID NO: 4227 - DNA, 19 bp, Artificial Sequence
  Description of Artificial Sequence: Chemically synthesized oligonucleotide
gagcattcccaggttggca

SEQ ID NO: 4228 - DNA, 19 bp, Artificial Sequence
  Description of Artificial Sequence: Chemically synthesized oligonucleotide
tgccaacctgggaatgctc

SEQ ID NO: 4229 - DNA, 19 bp, Artificial Sequence
  Description of Artificial Sequence: Chemically synthesized oligonucleotide
agcattcccaggttggcaa

SEQ ID NO: 4230 - DNA, 19 bp, Artificial Sequence
  Description of Artificial Sequence: Chemically synthesized oligonucleotide
ttgccaacctgggaatgct

SEQ ID NO: 4231 - DNA, 19 bp, Artificial Sequence
  Description of Artificial Sequence: Chemically synthesized oligonucleotide
gcattcccaggttggcaaa

SEQ ID NO: 4232 - DNA, 19 bp, Artificial Sequence
  Description of Artificial Sequence: Chemically synthesized oligonucleotide
tttgccaacctgggaatgc

SEQ ID NO: 4233 - DNA, 19 bp, Artificial Sequence
  Description of Artificial Sequence: Chemically synthesized oligonucleotide
cattcccaggttggcaaag

SEQ ID NO: 4234 - DNA, 19 bp, Artificial Sequence
  Description of Artificial Sequence: Chemically synthesized oligonucleotide
ctttgccaacctgggaatg

SEQ ID NO: 4235 - DNA, 19 bp, Artificial Sequence
  Description of Artificial Sequence: Chemically synthesized oligonucleotide
attcccaggttggcaaagg

SEQ ID NO: 4236 - DNA, 19 bp, Artificial Sequence
  Description of Artificial Sequence: Chemically synthesized oligonucleotide
cctttgccaacctgggaat

SEQ ID NO: 4237 - DNA, 19 bp, Artificial Sequence
  Description of Artificial Sequence: Chemically synthesized oligonucleotide
ttcccaggttggcaaagga

SEQ ID NO: 4238 - DNA, 19 bp, Artificial Sequence
  Description of Artificial Sequence: Chemically synthesized oligonucleotide
tcctttgccaacctgggaa

SEQ ID NO: 4239 - DNA, 19 bp, Artificial Sequence
  Description of Artificial Sequence: Chemically synthesized oligonucleotide
tcccaggttggcaaaggag

SEQ ID NO: 4240 - DNA, 19 bp, Artificial Sequence
  Description of Artificial Sequence: Chemically synthesized oligonucleotide
ctcctttgccaacctggga

SEQ ID NO: 4241 - DNA, 19 bp, Artificial Sequence
  Description of Artificial Sequence: Chemically synthesized oligonucleotide
cccaggttggcaaaggagc

SEQ ID NO: 4242 - DNA, 19 bp, Artificial Sequence
  Description of Artificial Sequence: Chemically synthesized oligonucleotide
gctcctttgccaacctggg

SEQ ID NO: 4243 - DNA, 19 bp, Artificial Sequence
  Description of Artificial Sequence: Chemically synthesized oligonucleotide
ccaggttggcaaaggagcc

SEQ ID NO: 4244 - DNA, 19 bp, Artificial Sequence
  Description of Artificial Sequence: Chemically synthesized oligonucleotide
ggctcctttgccaacctgg

SEQ ID NO: 4245 - DNA, 19 bp, Artificial Sequence
  Description of Artificial Sequence: Chemically synthesized oligonucleotide
caggttggcaaaggagccc

SEQ ID NO: 4246 - DNA, 19 bp, Artificial Sequence
  Description of Artificial Sequence: Chemically synthesized oligonucleotide
gggctcctttgccaacctg

SEQ ID NO: 4247 - DNA, 19 bp, Artificial Sequence
  Description of Artificial Sequence: Chemically synthesized oligonucleotide
aggttggcaaaggagccct

SEQ ID NO: 4248 - DNA, 19 bp, Artificial Sequence
  Description of Artificial Sequence: Chemically synthesized oligonucleotide
agggctcctttgccaacct

SEQ ID NO: 4249 - DNA, 19 bp, Artificial Sequence
  Description of Artificial Sequence: Chemically synthesized oligonucleotide
ggttggcaaaggagccctt

SEQ ID NO: 4250 - DNA, 19 bp, Artificial Sequence
  Description of Artificial Sequence: Chemically synthesized oligonucleotide
aagggctcctttgccaacc

SEQ ID NO: 4251 - DNA, 19 bp, Artificial Sequence
  Description of Artificial Sequence: Chemically synthesized oligonucleotide
gttggcaaaggagcccttg

SEQ ID NO: 4252 - DNA, 19 bp, Artificial Sequence
  Description of Artificial Sequence: Chemically synthesized oligonucleotide
caagggctcctttgccaac

SEQ ID NO: 4253 - DNA, 19 bp, Artificial Sequence
  Description of Artificial Sequence: Chemically synthesized oligonucleotide
ttggcaaaggagcccttgg

SEQ ID NO: 4254 - DNA, 19 bp, Artificial Sequence
  Description of Artificial Sequence: Chemically synthesized oligonucleotide
ccaagggctcctttgccaa

SEQ ID NO: 4255 - DNA, 19 bp, Artificial Sequence
  Description of Artificial Sequence: Chemically synthesized oligonucleotide
tggcaaaggagcccttggc

SEQ ID NO: 4256 - DNA, 19 bp, Artificial Sequence
  Description of Artificial Sequence: Chemically synthesized oligonucleotide
gccaagggctcctttgcca

SEQ ID NO: 4257 - DNA, 19 bp, Artificial Sequence
  Description of Artificial Sequence: Chemically synthesized oligonucleotide
ggcaaaggagcccttggca

SEQ ID NO: 4258 - DNA, 19 bp, Artificial Sequence
  Description of Artificial Sequence: Chemically synthesized oligonucleotide
tgccaagggctcctttgcc

SEQ ID NO: 4259 - DNA, 19 bp, Artificial Sequence
  Description of Artificial Sequence: Chemically synthesized oligonucleotide
gcaaaggagcccttggcag

SEQ ID NO: 4260 - DNA, 19 bp, Artificial Sequence
  Description of Artificial Sequence: Chemically synthesized oligonucleotide
ctgccaagggctcctttgc

SEQ ID NO: 4261 - DNA, 19 bp, Artificial Sequence
  Description of Artificial Sequence: Chemically synthesized oligonucleotide
caaaggagcccttggcagc

SEQ ID NO: 4262 - DNA, 19 bp, Artificial Sequence
  Description of Artificial Sequence: Chemically synthesized oligonucleotide
gctgccaagggctcctttg

SEQ ID NO: 4263 - DNA, 19 bp, Artificial Sequence
  Description of Artificial Sequence: Chemically synthesized oligonucleotide
aaaggagcccttggcagct

SEQ ID NO: 4264 - DNA, 19 bp, Artificial Sequence
  Description of Artificial Sequence: Chemically synthesized oligonucleotide
agctgccaagggctccttt

SEQ ID NO: 4265 - DNA, 19 bp, Artificial Sequence
  Description of Artificial Sequence: Chemically synthesized oligonucleotide
aaggagcccttggcagctg

SEQ ID NO: 4266 - DNA, 19 bp, Artificial Sequence
  Description of Artificial Sequence: Chemically synthesized oligonucleotide
cagctgccaagggctcctt

SEQ ID NO: 4267 - DNA, 19 bp, Artificial Sequence
  Description of Artificial Sequence: Chemically synthesized oligonucleotide
aggagcccttggcagctgc

SEQ ID NO: 4268 - DNA, 19 bp, Artificial Sequence
  Description of Artificial Sequence: Chemically synthesized oligonucleotide
gcagctgccaagggctcct

SEQ ID NO: 4269 - DNA, 19 bp, Artificial Sequence
  Description of Artificial Sequence: Chemically synthesized oligonucleotide
ggagcccttggcagctgcg

SEQ ID NO: 4270 - DNA, 19 bp, Artificial Sequence
  Description of Artificial Sequence: Chemically synthesized oligonucleotide
cgcagctgccaagggctcc

SEQ ID NO: 4271 - DNA, 19 bp, Artificial Sequence
  Description of Artificial Sequence: Chemically synthesized oligonucleotide
gagcccttggcagctgcgg

SEQ ID NO: 4272 - DNA, 19 bp, Artificial Sequence
  Description of Artificial Sequence: Chemically synthesized oligonucleotide
ccgcagctgccaagggctc

SEQ ID NO: 4273 - DNA, 19 bp, Artificial Sequence
  Description of Artificial Sequence: Chemically synthesized oligonucleotide
agcccttggcagctgcgga

SEQ ID NO: 4274 - DNA, 19 bp, Artificial Sequence
  Description of Artificial Sequence: Chemically synthesized oligonucleotide
tccgcagctgccaagggct

SEQ ID NO: 4275 - DNA, 19 bp, Artificial Sequence
  Description of Artificial Sequence: Chemically synthesized oligonucleotide
gcccttggcagctgcggaa

SEQ ID NO: 4276 - DNA, 19 bp, Artificial Sequence
  Description of Artificial Sequence: Chemically synthesized oligonucleotide
ttccgcagctgccaagggc

SEQ ID NO: 4277 - DNA, 19 bp, Artificial Sequence
  Description of Artificial Sequence: Chemically synthesized oligonucleotide
cccttggcagctgcggaac

SEQ ID NO: 4278 - DNA, 19 bp, Artificial Sequence
  Description of Artificial Sequence: Chemically synthesized oligonucleotide
gttccgcagctgccaaggg

SEQ ID NO: 4279 - DNA, 19 bp, Artificial Sequence
  Description of Artificial Sequence: Chemically synthesized oligonucleotide
ccttggcagctgcggaacc

SEQ ID NO: 4280 - DNA, 19 bp, Artificial Sequence
  Description of Artificial Sequence: Chemically synthesized oligonucleotide
ggttccgcagctgccaagg

SEQ ID NO: 4281 - DNA, 19 bp, Artificial Sequence
  Description of Artificial Sequence: Chemically synthesized oligonucleotide
cttggcagctgcggaacct

SEQ ID NO: 4282 - DNA, 19 bp, Artificial Sequence
  Description of Artificial Sequence: Chemically synthesized oligonucleotide
aggttccgcagctgccaag

SEQ ID NO: 4283 - DNA, 19 bp, Artificial Sequence
  Description of Artificial Sequence: Chemically synthesized oligonucleotide
ttggcagctgcggaacctg

SEQ ID NO: 4284 - DNA, 19 bp, Artificial Sequence
  Description of Artificial Sequence: Chemically synthesized oligonucleotide
caggttccgcagctgccaa

SEQ ID NO: 4285 - DNA, 19 bp, Artificial Sequence
  Description of Artificial Sequence: Chemically synthesized oligonucleotide
tggcagctgcggaacctgg

SEQ ID NO: 4286 - DNA, 19 bp, Artificial Sequence
  Description of Artificial Sequence: Chemically synthesized oligonucleotide
ccaggttccgcagctgcca

SEQ ID NO: 4287 - DNA, 19 bp, Artificial Sequence
  Description of Artificial Sequence: Chemically synthesized oligonucleotide
ggcagctgcggaacctggg

SEQ ID NO: 4288 - DNA, 19 bp, Artificial Sequence
  Description of Artificial Sequence: Chemically synthesized oligonucleotide
cccaggttccgcagctgcc

SEQ ID NO: 4289 - DNA, 19 bp, Artificial Sequence
  Description of Artificial Sequence: Chemically synthesized oligonucleotide
gcagctgcggaacctgggt

SEQ ID NO: 4290 - DNA, 19 bp, Artificial Sequence
  Description of Artificial Sequence: Chemically synthesized oligonucleotide
acccaggttccgcagctgc

SEQ ID NO: 4291 - DNA, 19 bp, Artificial Sequence
  Description of Artificial Sequence: Chemically synthesized oligonucleotide
cagctgcggaacctgggtt

SEQ ID NO: 4292 - DNA, 19 bp, Artificial Sequence
  Description of Artificial Sequence: Chemically synthesized oligonucleotide
aacccaggttccgcagctg

SEQ ID NO: 4293 - DNA, 19 bp, Artificial Sequence
  Description of Artificial Sequence: Chemically synthesized oligonucleotide
agctgcggaacctgggttg

SEQ ID NO: 4294 - DNA, 19 bp, Artificial Sequence
  Description of Artificial Sequence: Chemically synthesized oligonucleotide
caacccaggttccgcagct

SEQ ID NO: 4295 - DNA, 19 bp, Artificial Sequence
  Description of Artificial Sequence: Chemically synthesized oligonucleotide
gctgcggaacctgggttgt

SEQ ID NO: 4296 - DNA, 19 bp, Artificial Sequence
  Description of Artificial Sequence: Chemically synthesized oligonucleotide
acaacccaggttccgcagc

SEQ ID NO: 4297 - DNA, 19 bp, Artificial Sequence
  Description of Artificial Sequence: Chemically synthesized oligonucleotide
ctgcggaacctgggttgtt

SEQ ID NO: 4298 - DNA, 19 bp, Artificial Sequence
  Description of Artificial Sequence: Chemically synthesized oligonucleotide
aacaacccaggttccgcag

SEQ ID NO: 4299 - DNA, 19 bp, Artificial Sequence
  Description of Artificial Sequence: Chemically synthesized oligonucleotide
tgcggaacctgggttgttt

SEQ ID NO: 4300 - DNA, 19 bp, Artificial Sequence
  Description of Artificial Sequence: Chemically synthesized oligonucleotide
aaacaacccaggttccgca

SEQ ID NO: 4301 - DNA, 19 bp, Artificial Sequence
  Description of Artificial Sequence: Chemically synthesized oligonucleotide
gcggaacctgggttgtttg

SEQ ID NO: 4302 - DNA, 19 bp, Artificial Sequence
  Description of Artificial Sequence: Chemically synthesized oligonucleotide
caaacaacccaggttccgc

SEQ ID NO: 4303 - DNA, 19 bp, Artificial Sequence
  Description of Artificial Sequence: Chemically synthesized oligonucleotide
cggaacctgggttgtttgg

SEQ ID NO: 4304 - DNA, 19 bp, Artificial Sequence
  Description of Artificial Sequence: Chemically synthesized oligonucleotide
ccaaacaacccaggttccg

SEQ ID NO: 4305 - DNA, 19 bp, Artificial Sequence
  Description of Artificial Sequence: Chemically synthesized oligonucleotide
ggaacctgggttgtttggc

SEQ ID NO: 4306 - DNA, 19 bp, Artificial Sequence
  Description of Artificial Sequence: Chemically synthesized oligonucleotide
gccaaacaacccaggttcc

SEQ ID NO: 4307 - DNA, 19 bp, Artificial Sequence
  Description of Artificial Sequence: Chemically synthesized oligonucleotide
gaacctgggttgtttggct

SEQ ID NO: 4308 - DNA, 19 bp, Artificial Sequence
  Description of Artificial Sequence: Chemically synthesized oligonucleotide
agccaaacaacccaggttc

SEQ ID NO: 4309 - DNA, 19 bp, Artificial Sequence
  Description of Artificial Sequence: Chemically synthesized oligonucleotide
aacctgggttgtttggctt

SEQ ID NO: 4310 - DNA, 19 bp, Artificial Sequence
  Description of Artificial Sequence: Chemically synthesized oligonucleotide
aagccaaacaacccaggtt

SEQ ID NO: 4311 - DNA, 19 bp, Artificial Sequence
  Description of Artificial Sequence: Chemically synthesized oligonucleotide
acctgggttgtttggctta

SEQ ID NO: 4312 - DNA, 19 bp, Artificial Sequence
  Description of Artificial Sequence: Chemically synthesized oligonucleotide
taagccaaacaacccaggt

SEQ ID NO: 4313 - DNA, 19 bp, Artificial Sequence
  Description of Artificial Sequence: Chemically synthesized oligonucleotide
cctgggttgtttggcttaa

SEQ ID NO: 4314 - DNA, 19 bp, Artificial Sequence
  Description of Artificial Sequence: Chemically synthesized oligonucleotide
ttaagccaaacaacccagg

SEQ ID NO: 4315 - DNA, 19 bp, Artificial Sequence
  Description of Artificial Sequence: Chemically synthesized oligonucleotide
ctgggttgtttggcttaaa

SEQ ID NO: 4316 - DNA, 19 bp, Artificial Sequence
  Description of Artificial Sequence: Chemically synthesized oligonucleotide
tttaagccaaacaacccag

SEQ ID NO: 4317 - DNA, 19 bp, Artificial Sequence
  Description of Artificial Sequence: Chemically synthesized oligonucleotide
tgggttgtttggcttaaac

SEQ ID NO: 4318 - DNA, 19 bp, Artificial Sequence
  Description of Artificial Sequence: Chemically synthesized oligonucleotide
gtttaagccaaacaaccca

SEQ ID NO: 4319 - DNA, 19 bp, Artificial Sequence
  Description of Artificial Sequence: Chemically synthesized oligonucleotide
gggttgtttggcttaaact

SEQ ID NO: 4320 - DNA, 19 bp, Artificial Sequence
  Description of Artificial Sequence: Chemically synthesized oligonucleotide
agtttaagccaaacaaccc

SEQ ID NO: 4321 - DNA, 19 bp, Artificial Sequence
  Description of Artificial Sequence: Chemically synthesized oligonucleotide
ggttgtttggcttaaactc

SEQ ID NO: 4322 - DNA, 19 bp, Artificial Sequence
  Description of Artificial Sequence: Chemically synthesized oligonucleotide
gagtttaagccaaacaacc

SEQ ID NO: 4323 - DNA, 19 bp, Artificial Sequence
  Description of Artificial Sequence: Chemically synthesized oligonucleotide
gttgtttggcttaaactct

SEQ ID NO: 4324 - DNA, 19 bp, Artificial Sequence
  Description of Artificial Sequence: Chemically synthesized oligonucleotide
agagtttaagccaaacaac

SEQ ID NO: 4325 - DNA, 19 bp, Artificial Sequence
  Description of Artificial Sequence: Chemically synthesized oligonucleotide
ttgtttggcttaaactctg

SEQ ID NO: 4326 - DNA, 19 bp, Artificial Sequence
  Description of Artificial Sequence: Chemically synthesized oligonucleotide
cagagtttaagccaaacaa

SEQ ID NO: 4327 - DNA, 19 bp, Artificial Sequence
  Description of Artificial Sequence: Chemically synthesized oligonucleotide
tgtttggcttaaactctgg

SEQ ID NO: 4328 - DNA, 19 bp, Artificial Sequence
  Description of Artificial Sequence: Chemically synthesized oligonucleotide
ccagagtttaagccaaaca

SEQ ID NO: 4329 - DNA, 19 bp, Artificial Sequence
  Description of Artificial Sequence: Chemically synthesized oligonucleotide
gtttggcttaaactctggt

SEQ ID NO: 4330 - DNA, 19 bp, Artificial Sequence
  Description of Artificial Sequence: Chemically synthesized oligonucleotide
accagagtttaagccaaac

SEQ ID NO: 4331 - DNA, 19 bp, Artificial Sequence
  Description of Artificial Sequence: Chemically synthesized oligonucleotide
tttggcttaaactctggtg

SEQ ID NO: 4332 - DNA, 19 bp, Artificial Sequence
  Description of Artificial Sequence: Chemically synthesized oligonucleotide
caccagagtttaagccaaa

SEQ ID NO: 4333 - DNA, 19 bp, Artificial Sequence
  Description of Artificial Sequence: Chemically synthesized oligonucleotide
ttggcttaaactctggtgg

SEQ ID NO: 4334 - DNA, 19 bp, Artificial Sequence
  Description of Artificial Sequence: Chemically synthesized oligonucleotide
ccaccagagtttaagccaa

SEQ ID NO: 4335 - DNA, 19 bp, Artificial Sequence
  Description of Artificial Sequence: Chemically synthesized oligonucleotide
tggcttaaactctggtggg

SEQ ID NO: 4336 - DNA, 19 bp, Artificial Sequence
  Description of Artificial Sequence: Chemically synthesized oligonucleotide
cccaccagagtttaagcca

SEQ ID NO: 4337 - DNA, 19 bp, Artificial Sequence
  Description of Artificial Sequence: Chemically synthesized oligonucleotide
ggcttaaactctggtgggc

SEQ ID NO: 4338 - DNA, 19 bp, Artificial Sequence
  Description of Artificial Sequence: Chemically synthesized oligonucleotide
gcccaccagagtttaagcc

SEQ ID NO: 4339 - DNA, 19 bp, Artificial Sequence
  Description of Artificial Sequence: Chemically synthesized oligonucleotide
gcttaaactctggtgggca

SEQ ID NO: 4340 - DNA, 19 bp, Artificial Sequence
  Description of Artificial Sequence: Chemically synthesized oligonucleotide
tgcccaccagagtttaagc

SEQ ID NO: 4341 - DNA, 19 bp, Artificial Sequence
  Description of Artificial Sequence: Chemically synthesized oligonucleotide
cttaaactctggtgggcac

SEQ ID NO: 4342 - DNA, 19 bp, Artificial Sequence
  Description of Artificial Sequence: Chemically synthesized oligonucleotide
gtgcccaccagagtttaag

SEQ ID NO: 4343 - DNA, 19 bp, Artificial Sequence
  Description of Artificial Sequence: Chemically synthesized oligonucleotide
ttaaactctggtgggcacc

SEQ ID NO: 4344 - DNA, 19 bp, Artificial Sequence
  Description of Artificial Sequence: Chemically synthesized oligonucleotide
ggtgcccaccagagtttaa

SEQ ID NO: 4345 - DNA, 19 bp, Artificial Sequence
  Description of Artificial Sequence: Chemically synthesized oligonucleotide
taaactctggtgggcacct

SEQ ID NO: 4346 - DNA, 19 bp, Artificial Sequence
  Description of Artificial Sequence: Chemically synthesized oligonucleotide
aggtgcccaccagagttta

SEQ ID NO: 4347 - DNA, 19 bp, Artificial Sequence
  Description of Artificial Sequence: Chemically synthesized oligonucleotide
aaactctggtgggcacctg

SEQ ID NO: 4348 - DNA, 19 bp, Artificial Sequence
  Description of Artificial Sequence: Chemically synthesized oligonucleotide
caggtgcccaccagagttt

SEQ ID NO: 4349 - DNA, 19 bp, Artificial Sequence
  Description of Artificial Sequence: Chemically synthesized oligonucleotide
aactctggtgggcacctgc

SEQ ID NO: 4350 - DNA, 19 bp, Artificial Sequence
  Description of Artificial Sequence: Chemically synthesized oligonucleotide
gcaggtgcccaccagagtt

SEQ ID NO: 4351 - DNA, 19 bp, Artificial Sequence
  Description of Artificial Sequence: Chemically synthesized oligonucleotide
actctggtgggcacctgca

SEQ ID NO: 4352 - DNA, 19 bp, Artificial Sequence
  Description of Artificial Sequence: Chemically synthesized oligonucleotide
tgcaggtgcccaccagagt

SEQ ID NO: 4353 - DNA, 19 bp, Artificial Sequence
  Description of Artificial Sequence: Chemically synthesized oligonucleotide
ctctggtgggcacctgcag

SEQ ID NO: 4354 - DNA, 19 bp, Artificial Sequence
  Description of Artificial Sequence: Chemically synthesized oligonucleotide
ctgcaggtgcccaccagag

SEQ ID NO: 4355 - DNA, 19 bp, Artificial Sequence
  Description of Artificial Sequence: Chemically synthesized oligonucleotide
tctggtgggcacctgcaga

SEQ ID NO: 4356 - DNA, 19 bp, Artificial Sequence
  Description of Artificial Sequence: Chemically synthesized oligonucleotide
tctgcaggtgcccaccaga

SEQ ID NO: 4357 - DNA, 19 bp, Artificial Sequence
  Description of Artificial Sequence: Chemically synthesized oligonucleotide
ctggtgggcacctgcagag

SEQ ID NO: 4358 - DNA, 19 bp, Artificial Sequence
  Description of Artificial Sequence: Chemically synthesized oligonucleotide
ctctgcaggtgcccaccag

SEQ ID NO: 4359 - DNA, 19 bp, Artificial Sequence
  Description of Artificial Sequence: Chemically synthesized oligonucleotide
tggtgggcacctgcagaga

SEQ ID NO: 4360 - DNA, 19 bp, Artificial Sequence
  Description of Artificial Sequence: Chemically synthesized oligonucleotide
tctctgcaggtgcccacca

SEQ ID NO: 4361 - DNA, 19 bp, Artificial Sequence
  Description of Artificial Sequence: Chemically synthesized oligonucleotide
ggtgggcacctgcagagag

SEQ ID NO: 4362 - DNA, 19 bp, Artificial Sequence
  Description of Artificial Sequence: Chemically synthesized oligonucleotide
ctctctgcaggtgcccacc

SEQ ID NO: 4363 - DNA, 19 bp, Artificial Sequence
  Description of Artificial Sequence: Chemically synthesized oligonucleotide
gtgggcacctgcagagagc

SEQ ID NO: 4364 - DNA, 19 bp, Artificial Sequence
  Description of Artificial Sequence: Chemically synthesized oligonucleotide
gctctctgcaggtgcccac

SEQ ID NO: 4365 - DNA, 19 bp, Artificial Sequence
  Description of Artificial Sequence: Chemically synthesized oligonucleotide
tgggcacctgcagagagcc

SEQ ID NO: 4366 - DNA, 19 bp, Artificial Sequence
  Description of Artificial Sequence: Chemically synthesized oligonucleotide
ggctctctgcaggtgccca

SEQ ID NO: 4367 - DNA, 19 bp, Artificial Sequence
  Description of Artificial Sequence: Chemically synthesized oligonucleotide
gggcacctgcagagagccg

SEQ ID NO: 4368 - DNA, 19 bp, Artificial Sequence
  Description of Artificial Sequence: Chemically synthesized oligonucleotide
cggctctctgcaggtgccc

SEQ ID NO: 4369 - DNA, 19 bp, Artificial Sequence
  Description of Artificial Sequence: Chemically synthesized oligonucleotide
ggcacctgcagagagccgg

SEQ ID NO: 4370 - DNA, 19 bp, Artificial Sequence
  Description of Artificial Sequence: Chemically synthesized oligonucleotide
ccggctctctgcaggtgcc

SEQ ID NO: 4371 - DNA, 19 bp, Artificial Sequence
  Description of Artificial Sequence: Chemically synthesized oligonucleotide
gcacctgcagagagccggg

SEQ ID NO: 4372 - DNA, 19 bp, Artificial Sequence
  Description of Artificial Sequence: Chemically synthesized oligonucleotide
cccggctctctgcaggtgc

SEQ ID NO: 4373 - DNA, 19 bp, Artificial Sequence
  Description of Artificial Sequence: Chemically synthesized oligonucleotide
cacctgcagagagccgggg

SEQ ID NO: 4374 - DNA, 19 bp, Artificial Sequence
  Description of Artificial Sequence: Chemically synthesized oligonucleotide
ccccggctctctgcaggtg

SEQ ID NO: 4375 - DNA, 19 bp, Artificial Sequence
  Description of Artificial Sequence: Chemically synthesized oligonucleotide
acctgcagagagccgggga

SEQ ID NO: 4376 - DNA, 19 bp, Artificial Sequence
  Description of Artificial Sequence: Chemically synthesized oligonucleotide
tccccggctctctgcaggt

SEQ ID NO: 4377 - DNA, 19 bp, Artificial Sequence
  Description of Artificial Sequence: Chemically synthesized oligonucleotide
cctgcagagagccggggag

SEQ ID NO: 4378 - DNA, 19 bp, Artificial Sequence
  Description of Artificial Sequence: Chemically synthesized oligonucleotide
ctccccggctctctgcagg

SEQ ID NO: 4379 - DNA, 19 bp, Artificial Sequence
  Description of Artificial Sequence: Chemically synthesized oligonucleotide
ctgcagagagccggggagg

SEQ ID NO: 4380 - DNA, 19 bp, Artificial Sequence
  Description of Artificial Sequence: Chemically synthesized oligonucleotide
cctccccggctctctgcag

SEQ ID NO: 4381 - DNA, 19 bp, Artificial Sequence
  Description of Artificial Sequence: Chemically synthesized oligonucleotide
tgcagagagccggggaggc

SEQ ID NO: 4382 - DNA, 19 bp, Artificial Sequence
  Description of Artificial Sequence: Chemically synthesized oligonucleotide
gcctccccggctctctgca

SEQ ID NO: 4383 - DNA, 19 bp, Artificial Sequence
  Description of Artificial Sequence: Chemically synthesized oligonucleotide
gcagagagccggggaggcc

SEQ ID NO: 4384 - DNA, 19 bp, Artificial Sequence
  Description of Artificial Sequence: Chemically synthesized oligonucleotide
ggcctccccggctctctgc

SEQ ID NO: 4385 - DNA, 19 bp, Artificial Sequence
  Description of Artificial Sequence: Chemically synthesized oligonucleotide
cagagagccggggaggccg

SEQ ID NO: 4386 - DNA, 19 bp, Artificial Sequence
  Description of Artificial Sequence: Chemically synthesized oligonucleotide
cggcctccccggctctctg

SEQ ID NO: 4387 - DNA, 19 bp, Artificial Sequence
  Description of Artificial Sequence: Chemically synthesized oligonucleotide
agagagccggggaggccga

SEQ ID NO: 4388 - DNA, 19 bp, Artificial Sequence
  Description of Artificial Sequence: Chemically synthesized oligonucleotide
tcggcctccccggctctct

SEQ ID NO: 4389 - DNA, 19 bp, Artificial Sequence
  Description of Artificial Sequence: Chemically synthesized oligonucleotide
gagagccggggaggccgaa

SEQ ID NO: 4390 - DNA, 19 bp, Artificial Sequence
  Description of Artificial Sequence: Chemically synthesized oligonucleotide
ttcggcctccccggctctc

SEQ ID NO: 4391 - DNA, 19 bp, Artificial Sequence
  Description of Artificial Sequence: Chemically synthesized oligonucleotide
agagccggggaggccgaac

SEQ ID NO: 4392 - DNA, 19 bp, Artificial Sequence
  Description of Artificial Sequence: Chemically synthesized oligonucleotide
gttcggcctccccggctct

SEQ ID NO: 4393 - DNA, 19 bp, Artificial Sequence
  Description of Artificial Sequence: Chemically synthesized oligonucleotide
gagccggggaggccgaacg

SEQ ID NO: 4394 - DNA, 19 bp, Artificial Sequence
  Description of Artificial Sequence: Chemically synthesized oligonucleotide
cgttcggcctccccggctc

SEQ ID NO: 4395 - DNA, 19 bp, Artificial Sequence
  Description of Artificial Sequence: Chemically synthesized oligonucleotide
agccggggaggccgaacgc

SEQ ID NO: 4396 - DNA, 19 bp, Artificial Sequence
  Description of Artificial Sequence: Chemically synthesized oligonucleotide
gcgttcggcctccccggct

SEQ ID NO: 4397 - DNA, 19 bp, Artificial Sequence
  Description of Artificial Sequence: Chemically synthesized oligonucleotide
gccggggaggccgaacgcc

SEQ ID NO: 4398 - DNA, 19 bp, Artificial Sequence
  Description of Artificial Sequence: Chemically synthesized oligonucleotide
ggcgttcggcctccccggc

SEQ ID NO: 4399 - DNA, 19 bp, Artificial Sequence
  Description of Artificial Sequence: Chemically synthesized oligonucleotide
ccggggaggccgaacgccc

SEQ ID NO: 4400 - DNA, 19 bp, Artificial Sequence
  Description of Artificial Sequence: Chemically synthesized oligonucleotide
gggcgttcggcctccccgg

SEQ ID NO: 4401 - DNA, 19 bp, Artificial Sequence
  Description of Artificial Sequence: Chemically synthesized oligonucleotide
cggggaggccgaacgccct

SEQ ID NO: 4402 - DNA, 19 bp, Artificial Sequence
  Description of Artificial Sequence: Chemically synthesized oligonucleotide
agggcgttcggcctccccg

SEQ ID NO: 4403 - DNA, 19 bp, Artificial Sequence
  Description of Artificial Sequence: Chemically synthesized oligonucleotide
ggggaggccgaacgccctt

SEQ ID NO: 4404 - DNA, 19 bp, Artificial Sequence
  Description of Artificial Sequence: Chemically synthesized oligonucleotide
aagggcgttcggcctcccc

SEQ ID NO: 4405 - DNA, 19 bp, Artificial Sequence
  Description of Artificial Sequence: Chemically synthesized oligonucleotide
gggaggccgaacgcccttc

SEQ ID NO: 4406 - DNA, 19 bp, Artificial Sequence
  Description of Artificial Sequence: Chemically synthesized oligonucleotide
gaagggcgttcggcctccc

SEQ ID NO: 4407 - DNA, 19 bp, Artificial Sequence
  Description of Artificial Sequence: Chemically synthesized oligonucleotide
ggaggccgaacgcccttca

SEQ ID NO: 4408 - DNA, 19 bp, Artificial Sequence
  Description of Artificial Sequence: Chemically synthesized oligonucleotide
tgaagggcgttcggcctcc

SEQ ID NO: 4409 - DNA, 19 bp, Artificial Sequence
  Description of Artificial Sequence: Chemically synthesized oligonucleotide
gaggccgaacgcccttcac

SEQ ID NO: 4410 - DNA, 19 bp, Artificial Sequence
  Description of Artificial Sequence: Chemically synthesized oligonucleotide
gtgaagggcgttcggcctc

SEQ ID NO: 4411 - DNA, 19 bp, Artificial Sequence
  Description of Artificial Sequence: Chemically synthesized oligonucleotide
aggccgaacgcccttcact

SEQ ID NO: 4412 - DNA, 19 bp, Artificial Sequence
  Description of Artificial Sequence: Chemically synthesized oligonucleotide
agtgaagggcgttcggcct

SEQ ID NO: 4413 - DNA, 19 bp, Artificial Sequence
  Description of Artificial Sequence: Chemically synthesized oligonucleotide
ggccgaacgcccttcactg

SEQ ID NO: 4414 - DNA, 19 bp, Artificial Sequence
  Description of Artificial Sequence: Chemically synthesized oligonucleotide
cagtgaagggcgttcggcc

SEQ ID NO: 4415 - DNA, 19 bp, Artificial Sequence
  Description of Artificial Sequence: Chemically synthesized oligonucleotide
gccgaacgcccttcactgc

SEQ ID NO: 4416 - DNA, 19 bp, Artificial Sequence
  Description of Artificial Sequence: Chemically synthesized oligonucleotide
gcagtgaagggcgttcggc

SEQ ID NO: 4417 - DNA, 19 bp, Artificial Sequence
  Description of Artificial Sequence: Chemically synthesized oligonucleotide
ccgaacgcccttcactgca

SEQ ID NO: 4418 - DNA, 19 bp, Artificial Sequence
  Description of Artificial Sequence: Chemically synthesized oligonucleotide
tgcagtgaagggcgttcgg

SEQ ID NO: 4419 - DNA, 19 bp, Artificial Sequence
  Description of Artificial Sequence: Chemically synthesized oligonucleotide
cgaacgcccttcactgcac

SEQ ID NO: 4420 - DNA, 19 bp, Artificial Sequence
  Description of Artificial Sequence: Chemically synthesized oligonucleotide
gtgcagtgaagggcgttcg

SEQ ID NO: 4421 - DNA, 19 bp, Artificial Sequence
  Description of Artificial Sequence: Chemically synthesized oligonucleotide
gaacgcccttcactgcacc

SEQ ID NO: 4422 - DNA, 19 bp, Artificial Sequence
  Description of Artificial Sequence: Chemically synthesized oligonucleotide
ggtgcagtgaagggcgttc

SEQ ID NO: 4423 - DNA, 19 bp, Artificial Sequence
  Description of Artificial Sequence: Chemically synthesized oligonucleotide
aacgcccttcactgcacca

SEQ ID NO: 4424 - DNA, 19 bp, Artificial Sequence
  Description of Artificial Sequence: Chemically synthesized oligonucleotide
tggtgcagtgaagggcgtt

SEQ ID NO: 4425 - DNA, 19 bp, Artificial Sequence
  Description of Artificial Sequence: Chemically synthesized oligonucleotide
acgcccttcactgcaccag

SEQ ID NO: 4426 - DNA, 19 bp, Artificial Sequence
  Description of Artificial Sequence: Chemically synthesized oligonucleotide
ctggtgcagtgaagggcgt

SEQ ID NO: 4427 - DNA, 19 bp, Artificial Sequence
  Description of Artificial Sequence: Chemically synthesized oligonucleotide
cgcccttcactgcaccaga

SEQ ID NO: 4428 - DNA, 19 bp, Artificial Sequence
  Description of Artificial Sequence: Chemically synthesized oligonucleotide
tctggtgcagtgaagggcg

SEQ ID NO: 4429 - DNA, 19 bp, Artificial Sequence
  Description of Artificial Sequence: Chemically synthesized oligonucleotide
gcccttcactgcaccagag

SEQ ID NO: 4430 - DNA, 19 bp, Artificial Sequence
  Description of Artificial Sequence: Chemically synthesized oligonucleotide
ctctggtgcagtgaagggc

SEQ ID NO: 4431 - DNA, 19 bp, Artificial Sequence
  Description of Artificial Sequence: Chemically synthesized oligonucleotide
cccttcactgcaccagagg

SEQ ID NO: 4432 - DNA, 19 bp, Artificial Sequence
  Description of Artificial Sequence: Chemically synthesized oligonucleotide
cctctggtgcagtgaaggg

SEQ ID NO: 4433 - DNA, 19 bp, Artificial Sequence
  Description of Artificial Sequence: Chemically synthesized oligonucleotide
ccttcactgcaccagaggg

SEQ ID NO: 4434 - DNA, 19 bp, Artificial Sequence
  Description of Artificial Sequence: Chemically synthesized oligonucleotide
ccctctggtgcagtgaagg

SEQ ID NO: 4435 - DNA, 19 bp, Artificial Sequence
  Description of Artificial Sequence: Chemically synthesized oligonucleotide
cttcactgcaccagaggga

SEQ ID NO: 4436 - DNA, 19 bp, Artificial Sequence
  Description of Artificial Sequence: Chemically synthesized oligonucleotide
tccctctggtgcagtgaag

SEQ ID NO: 4437 - DNA, 19 bp, Artificial Sequence
  Description of Artificial Sequence: Chemically synthesized oligonucleotide
ttcactgcaccagagggat

SEQ ID NO: 4438 - DNA, 19 bp, Artificial Sequence
  Description of Artificial Sequence: Chemically synthesized oligonucleotide
atccctctggtgcagtgaa

SEQ ID NO: 4439 - DNA, 19 bp, Artificial Sequence
  Description of Artificial Sequence: Chemically synthesized oligonucleotide
tcactgcaccagagggatg

SEQ ID NO: 4440 - DNA, 19 bp, Artificial Sequence
  Description of Artificial Sequence: Chemically synthesized oligonucleotide
catccctctggtgcagtga

SEQ ID NO: 4441 - DNA, 19 bp, Artificial Sequence
  Description of Artificial Sequence: Chemically synthesized oligonucleotide
cactgcaccagagggatgg

SEQ ID NO: 4442 - DNA, 19 bp, Artificial Sequence
  Description of Artificial Sequence: Chemically synthesized oligonucleotide
ccatccctctggtgcagtg

SEQ ID NO: 4443 - DNA, 19 bp, Artificial Sequence
  Description of Artificial Sequence: Chemically synthesized oligonucleotide
actgcaccagagggatgga

SEQ ID NO: 4444 - DNA, 19 bp, Artificial Sequence
  Description of Artificial Sequence: Chemically synthesized oligonucleotide
tccatccctctggtgcagt

SEQ ID NO: 4445 - DNA, 19 bp, Artificial Sequence
  Description of Artificial Sequence: Chemically synthesized oligonucleotide
ctgcaccagagggatggag

SEQ ID NO: 4446 - DNA, 19 bp, Artificial Sequence
  Description of Artificial Sequence: Chemically synthesized oligonucleotide
ctccatccctctggtgcag

SEQ ID NO: 4447 - DNA, 19 bp, Artificial Sequence
  Description of Artificial Sequence: Chemically synthesized oligonucleotide
tgcaccagagggatggaga

SEQ ID NO: 4448 - DNA, 19 bp, Artificial Sequence
  Description of Artificial Sequence: Chemically synthesized oligonucleotide
tctccatccctctggtgca

SEQ ID NO: 4449 - DNA, 19 bp, Artificial Sequence
  Description of Artificial Sequence: Chemically synthesized oligonucleotide
gcaccagagggatggagag

SEQ ID NO: 4450 - DNA, 19 bp, Artificial Sequence
  Description of Artificial Sequence: Chemically synthesized oligonucleotide
ctctccatccctctggtgc

SEQ ID NO: 4451 - DNA, 19 bp, Artificial Sequence
  Description of Artificial Sequence: Chemically synthesized oligonucleotide
caccagagggatggagaga

SEQ ID NO: 4452 - DNA, 19 bp, Artificial Sequence
  Description of Artificial Sequence: Chemically synthesized oligonucleotide
tctctccatccctctggtg

SEQ ID NO: 4453 - DNA, 19 bp, Artificial Sequence
  Description of Artificial Sequence: Chemically synthesized oligonucleotide
accagagggatggagagat

SEQ ID NO: 4454 - DNA, 19 bp, Artificial Sequence
  Description of Artificial Sequence: Chemically synthesized oligonucleotide
atctctccatccctctggt

SEQ ID NO: 4455 - DNA, 19 bp, Artificial Sequence
  Description of Artificial Sequence: Chemically synthesized oligonucleotide
ccagagggatggagagatg

SEQ ID NO: 4456 - DNA, 19 bp, Artificial Sequence
  Description of Artificial Sequence: Chemically synthesized oligonucleotide
catctctccatccctctgg

SEQ ID NO: 4457 - DNA, 19 bp, Artificial Sequence
  Description of Artificial Sequence: Chemically synthesized oligonucleotide
cagagggatggagagatgg

SEQ ID NO: 4458 - DNA, 19 bp, Artificial Sequence
  Description of Artificial Sequence: Chemically synthesized oligonucleotide
ccatctctccatccctctg

SEQ ID NO: 4459 - DNA, 19 bp, Artificial Sequence
  Description of Artificial Sequence: Chemically synthesized oligonucleotide
agagggatggagagatggg

SEQ ID NO: 4460 - DNA, 19 bp, Artificial Sequence
  Description of Artificial Sequence: Chemically synthesized oligonucleotide
cccatctctccatccctct

SEQ ID NO: 4461 - DNA, 19 bp, Artificial Sequence
  Description of Artificial Sequence: Chemically synthesized oligonucleotide
gagggatggagagatggga

SEQ ID NO: 4462 - DNA, 19 bp, Artificial Sequence
  Description of Artificial Sequence: Chemically synthesized oligonucleotide
tcccatctctccatccctc

SEQ ID NO: 4463 - DNA, 19 bp, Artificial Sequence
  Description of Artificial Sequence: Chemically synthesized oligonucleotide
agggatggagagatgggag

SEQ ID NO: 4464 - DNA, 19 bp, Artificial Sequence
  Description of Artificial Sequence: Chemically synthesized oligonucleotide
ctcccatctctccatccct

SEQ ID NO: 4465 - DNA, 19 bp, Artificial Sequence
  Description of Artificial Sequence: Chemically synthesized oligonucleotide
gggatggagagatgggagc

SEQ ID NO: 4466 - DNA, 19 bp, Artificial Sequence
  Description of Artificial Sequence: Chemically synthesized oligonucleotide
gctcccatctctccatccc

SEQ ID NO: 4467 - DNA, 19 bp, Artificial Sequence
  Description of Artificial Sequence: Chemically synthesized oligonucleotide
ggatggagagatgggagct

SEQ ID NO: 4468 - DNA, 19 bp, Artificial Sequence
  Description of Artificial Sequence: Chemically synthesized oligonucleotide
agctcccatctctccatcc

SEQ ID NO: 4469 - DNA, 19 bp, Artificial Sequence
  Description of Artificial Sequence: Chemically synthesized oligonucleotide
gatggagagatgggagctg

SEQ ID NO: 4470 - DNA, 19 bp, Artificial Sequence
  Description of Artificial Sequence: Chemically synthesized oligonucleotide
cagctcccatctctccatc

SEQ ID NO: 4471 - DNA, 19 bp, Artificial Sequence
  Description of Artificial Sequence: Chemically synthesized oligonucleotide
atggagagatgggagctgg

SEQ ID NO: 4472 - DNA, 19 bp, Artificial Sequence
  Description of Artificial Sequence: Chemically synthesized oligonucleotide
ccagctcccatctctccat

SEQ ID NO: 4473 - DNA, 19 bp, Artificial Sequence
  Description of Artificial Sequence: Chemically synthesized oligonucleotide
tggagagatgggagctggc

SEQ ID NO: 4474 - DNA, 19 bp, Artificial Sequence
  Description of Artificial Sequence: Chemically synthesized oligonucleotide
gccagctcccatctctcca

SEQ ID NO: 4475 - DNA, 19 bp, Artificial Sequence
  Description of Artificial Sequence: Chemically synthesized oligonucleotide
ggagagatgggagctggcc

SEQ ID NO: 4476 - DNA, 19 bp, Artificial Sequence
  Description of Artificial Sequence: Chemically synthesized oligonucleotide
ggccagctcccatctctcc

SEQ ID NO: 4477 - DNA, 19 bp, Artificial Sequence
  Description of Artificial Sequence: Chemically synthesized oligonucleotide
gagagatgggagctggccg

SEQ ID NO: 4478 - DNA, 19 bp, Artificial Sequence
  Description of Artificial Sequence: Chemically synthesized oligonucleotide
cggccagctcccatctctc

SEQ ID NO: 4479 - DNA, 19 bp, Artificial Sequence
  Description of Artificial Sequence: Chemically synthesized oligonucleotide
agagatgggagctggccgg

SEQ ID NO: 4480 - DNA, 19 bp, Artificial Sequence
  Description of Artificial Sequence: Chemically synthesized oligonucleotide
ccggccagctcccatctct

SEQ ID NO: 4481 - DNA, 19 bp, Artificial Sequence
  Description of Artificial Sequence: Chemically synthesized oligonucleotide
gagatgggagctggccggc

SEQ ID NO: 4482 - DNA, 19 bp, Artificial Sequence
  Description of Artificial Sequence: Chemically synthesized oligonucleotide
gccggccagctcccatctc

SEQ ID NO: 4483 - DNA, 19 bp, Artificial Sequence
  Description of Artificial Sequence: Chemically synthesized oligonucleotide
agatgggagctggccggca

SEQ ID NO: 4484 - DNA, 19 bp, Artificial Sequence
  Description of Artificial Sequence: Chemically synthesized oligonucleotide
tgccggccagctcccatct

SEQ ID NO: 4485 - DNA, 19 bp, Artificial Sequence
  Description of Artificial Sequence: Chemically synthesized oligonucleotide
gatgggagctggccggcag

SEQ ID NO: 4486 - DNA, 19 bp, Artificial Sequence
  Description of Artificial Sequence: Chemically synthesized oligonucleotide
ctgccggccagctcccatc

SEQ ID NO: 4487 - DNA, 19 bp, Artificial Sequence
  Description of Artificial Sequence: Chemically synthesized oligonucleotide
atgggagctggccggcagc

SEQ ID NO: 4488 - DNA, 19 bp, Artificial Sequence
  Description of Artificial Sequence: Chemically synthesized oligonucleotide
gctgccggccagctcccat

SEQ ID NO: 4489 - DNA, 19 bp, Artificial Sequence
  Description of Artificial Sequence: Chemically synthesized oligonucleotide
tgggagctggccggcagca

SEQ ID NO: 4490 - DNA, 19 bp, Artificial Sequence
  Description of Artificial Sequence: Chemically synthesized oligonucleotide
tgctgccggccagctccca

SEQ ID NO: 4491 - DNA, 19 bp, Artificial Sequence
  Description of Artificial Sequence: Chemically synthesized oligonucleotide
gggagctggccggcagcag

SEQ ID NO: 4492 - DNA, 19 bp, Artificial Sequence
  Description of Artificial Sequence: Chemically synthesized oligonucleotide
ctgctgccggccagctccc

SEQ ID NO: 4493 - DNA, 19 bp, Artificial Sequence
  Description of Artificial Sequence: Chemically synthesized oligonucleotide
ggagctggccggcagcaga

SEQ ID NO: 4494 - DNA, 19 bp, Artificial Sequence
  Description of Artificial Sequence: Chemically synthesized oligonucleotide
tctgctgccggccagctcc

SEQ ID NO: 4495 - DNA, 19 bp, Artificial Sequence
  Description of Artificial Sequence: Chemically synthesized oligonucleotide
gagctggccggcagcagaa

SEQ ID NO: 4496 - DNA, 19 bp, Artificial Sequence
  Description of Artificial Sequence: Chemically synthesized oligonucleotide
ttctgctgccggccagctc

SEQ ID NO: 4497 - DNA, 19 bp, Artificial Sequence
  Description of Artificial Sequence: Chemically synthesized oligonucleotide
agctggccggcagcagaat

SEQ ID NO: 4498 - DNA, 19 bp, Artificial Sequence
  Description of Artificial Sequence: Chemically synthesized oligonucleotide
attctgctgccggccagct

SEQ ID NO: 4499 - DNA, 19 bp, Artificial Sequence
  Description of Artificial Sequence: Chemically synthesized oligonucleotide
gctggccggcagcagaatc

SEQ ID NO: 4500 - DNA, 19 bp, Artificial Sequence
  Description of Artificial Sequence: Chemically synthesized oligonucleotide
gattctgctgccggccagc

SEQ ID NO: 4501 - DNA, 19 bp, Artificial Sequence
  Description of Artificial Sequence: Chemically synthesized oligonucleotide
ctggccggcagcagaatcc

SEQ ID NO: 4502 - DNA, 19 bp, Artificial Sequence
  Description of Artificial Sequence: Chemically synthesized oligonucleotide
ggattctgctgccggccag

SEQ ID NO: 4503 - DNA, 19 bp, Artificial Sequence
  Description of Artificial Sequence: Chemically synthesized oligonucleotide
tggccggcagcagaatcct

SEQ ID NO: 4504 - DNA, 19 bp, Artificial Sequence
  Description of Artificial Sequence: Chemically synthesized oligonucleotide
aggattctgctgccggcca

SEQ ID NO: 4505 - DNA, 19 bp, Artificial Sequence
  Description of Artificial Sequence: Chemically synthesized oligonucleotide
ggccggcagcagaatcctt

SEQ ID NO: 4506 - DNA, 19 bp, Artificial Sequence
  Description of Artificial Sequence: Chemically synthesized oligonucleotide
aaggattctgctgccggcc

SEQ ID NO: 4507 - DNA, 19 bp, Artificial Sequence
  Description of Artificial Sequence: Chemically synthesized oligonucleotide
gccggcagcagaatccttg

SEQ ID NO: 4508 - DNA, 19 bp, Artificial Sequence
  Description of Artificial Sequence: Chemically synthesized oligonucleotide
caaggattctgctgccggc

SEQ ID NO: 4509 - DNA, 19 bp, Artificial Sequence
  Description of Artificial Sequence: Chemically synthesized oligonucleotide
ccggcagcagaatccttgc

SEQ ID NO: 4510 - DNA, 19 bp, Artificial Sequence
  Description of Artificial Sequence: Chemically synthesized oligonucleotide
gcaaggattctgctgccgg

SEQ ID NO: 4511 - DNA, 19 bp, Artificial Sequence
  Description of Artificial Sequence: Chemically synthesized oligonucleotide
cggcagcagaatccttgcc

SEQ ID NO: 4512 - DNA, 19 bp, Artificial Sequence
  Description of Artificial Sequence: Chemically synthesized oligonucleotide
ggcaaggattctgctgccg

SEQ ID NO: 4513 - DNA, 19 bp, Artificial Sequence
  Description of Artificial Sequence: Chemically synthesized oligonucleotide
ggcagcagaatccttgccc

SEQ ID NO: 4514 - DNA, 19 bp, Artificial Sequence
  Description of Artificial Sequence: Chemically synthesized oligonucleotide
gggcaaggattctgctgcc

SEQ ID NO: 4515 - DNA, 19 bp, Artificial Sequence
  Description of Artificial Sequence: Chemically synthesized oligonucleotide
gcagcagaatccttgcccg

SEQ ID NO: 4516 - DNA, 19 bp, Artificial Sequence
  Description of Artificial Sequence: Chemically synthesized oligonucleotide
cgggcaaggattctgctgc

SEQ ID NO: 4517 - DNA, 19 bp, Artificial Sequence
  Description of Artificial Sequence: Chemically synthesized oligonucleotide
cagcagaatccttgcccgc

SEQ ID NO: 4518 - DNA, 19 bp, Artificial Sequence
  Description of Artificial Sequence: Chemically synthesized oligonucleotide
gcgggcaaggattctgctg

SEQ ID NO: 4519 - DNA, 19 bp, Artificial Sequence
  Description of Artificial Sequence: Chemically synthesized oligonucleotide
agcagaatccttgcccgct

SEQ ID NO: 4520 - DNA, 19 bp, Artificial Sequence
  Description of Artificial Sequence: Chemically synthesized oligonucleotide
agcgggcaaggattctgct

SEQ ID NO: 4521 - DNA, 19 bp, Artificial Sequence
  Description of Artificial Sequence: Chemically synthesized oligonucleotide
gcagaatccttgcccgctc

SEQ ID NO: 4522 - DNA, 19 bp, Artificial Sequence
  Description of Artificial Sequence: Chemically synthesized oligonucleotide
gagcgggcaaggattctgc

SEQ ID NO: 4523 - DNA, 19 bp, Artificial Sequence
  Description of Artificial Sequence: Chemically synthesized oligonucleotide
cagaatccttgcccgctct

SEQ ID NO: 4524 - DNA, 19 bp, Artificial Sequence
  Description of Artificial Sequence: Chemically synthesized oligonucleotide
agagcgggcaaggattctg

SEQ ID NO: 4525 - DNA, 19 bp, Artificial Sequence
  Description of Artificial Sequence: Chemically synthesized oligonucleotide
agaatccttgcccgctctt

SEQ ID NO: 4526 - DNA, 19 bp, Artificial Sequence
  Description of Artificial Sequence: Chemically synthesized oligonucleotide
aagagcgggcaaggattct

SEQ ID NO: 4527 - DNA, 19 bp, Artificial Sequence
  Description of Artificial Sequence: Chemically synthesized oligonucleotide
gaatccttgcccgctcttc

SEQ ID NO: 4528 - DNA, 19 bp, Artificial Sequence
  Description of Artificial Sequence: Chemically synthesized oligonucleotide
gaagagcgggcaaggattc

SEQ ID NO: 4529 - DNA, 19 bp, Artificial Sequence
  Description of Artificial Sequence: Chemically synthesized oligonucleotide
aatccttgcccgctcttcc

SEQ ID NO: 4530 - DNA, 19 bp, Artificial Sequence
  Description of Artificial Sequence: Chemically synthesized oligonucleotide
ggaagagcgggcaaggatt

SEQ ID NO: 4531 - DNA, 19 bp, Artificial Sequence
  Description of Artificial Sequence: Chemically synthesized oligonucleotide
atccttgcccgctcttcct

SEQ ID NO: 4532 - DNA, 19 bp, Artificial Sequence
  Description of Artificial Sequence: Chemically synthesized oligonucleotide
aggaagagcgggcaaggat

SEQ ID NO: 4533 - DNA, 19 bp, Artificial Sequence
  Description of Artificial Sequence: Chemically synthesized oligonucleotide
tccttgcccgctcttcctg

SEQ ID NO: 4534 - DNA, 19 bp, Artificial Sequence
  Description of Artificial Sequence: Chemically synthesized oligonucleotide
caggaagagcgggcaagga

SEQ ID NO: 4535 - DNA, 19 bp, Artificial Sequence
  Description of Artificial Sequence: Chemically synthesized oligonucleotide
ccttgcccgctcttcctgg

SEQ ID NO: 4536 - DNA, 19 bp, Artificial Sequence
  Description of Artificial Sequence: Chemically synthesized oligonucleotide
ccaggaagagcgggcaagg

SEQ ID NO: 4537 - DNA, 19 bp, Artificial Sequence
  Description of Artificial Sequence: Chemically synthesized oligonucleotide
cttgcccgctcttcctggg

SEQ ID NO: 4538 - DNA, 19 bp, Artificial Sequence
  Description of Artificial Sequence: Chemically synthesized oligonucleotide
cccaggaagagcgggcaag

SEQ ID NO: 4539 - DNA, 19 bp, Artificial Sequence
  Description of Artificial Sequence: Chemically synthesized oligonucleotide
ttgcccgctcttcctgggg

SEQ ID NO: 4540 - DNA, 19 bp, Artificial Sequence
  Description of Artificial Sequence: Chemically synthesized oligonucleotide
ccccaggaagagcgggcaa

SEQ ID NO: 4541 - DNA, 19 bp, Artificial Sequence
  Description of Artificial Sequence: Chemically synthesized oligonucleotide
tgcccgctcttcctggggc

SEQ ID NO: 4542 - DNA, 19 bp, Artificial Sequence
  Description of Artificial Sequence: Chemically synthesized oligonucleotide
gccccaggaagagcgggca

SEQ ID NO: 4543 - DNA, 19 bp, Artificial Sequence
  Description of Artificial Sequence: Chemically synthesized oligonucleotide
gcccgctcttcctggggca

SEQ ID NO: 4544 - DNA, 19 bp, Artificial Sequence
  Description of Artificial Sequence: Chemically synthesized oligonucleotide
tgccccaggaagagcgggc

SEQ ID NO: 4545 - DNA, 19 bp, Artificial Sequence
  Description of Artificial Sequence: Chemically synthesized oligonucleotide
cccgctcttcctggggcag

SEQ ID NO: 4546 - DNA, 19 bp, Artificial Sequence
  Description of Artificial Sequence: Chemically synthesized oligonucleotide
ctgccccaggaagagcggg

SEQ ID NO: 4547 - DNA, 19 bp, Artificial Sequence
  Description of Artificial Sequence: Chemically synthesized oligonucleotide
ccgctcttcctggggcagc

SEQ ID NO: 4548 - DNA, 19 bp, Artificial Sequence
  Description of Artificial Sequence: Chemically synthesized oligonucleotide
gctgccccaggaagagcgg

SEQ ID NO: 4549 - DNA, 19 bp, Artificial Sequence
  Description of Artificial Sequence: Chemically synthesized oligonucleotide
cgctcttcctggggcagcc

SEQ ID NO: 4550 - DNA, 19 bp, Artificial Sequence
  Description of Artificial Sequence: Chemically synthesized oligonucleotide
ggctgccccaggaagagcg

SEQ ID NO: 4551 - DNA, 19 bp, Artificial Sequence
  Description of Artificial Sequence: Chemically synthesized oligonucleotide
gctcttcctggggcagcca

SEQ ID NO: 4552 - DNA, 19 bp, Artificial Sequence
  Description of Artificial Sequence: Chemically synthesized oligonucleotide
tggctgccccaggaagagc

SEQ ID NO: 4553 - DNA, 19 bp, Artificial Sequence
  Description of Artificial Sequence: Chemically synthesized oligonucleotide
ctcttcctggggcagccag

SEQ ID NO: 4554 - DNA, 19 bp, Artificial Sequence
  Description of Artificial Sequence: Chemically synthesized oligonucleotide
ctggctgccccaggaagag

SEQ ID NO: 4555 - DNA, 19 bp, Artificial Sequence
  Description of Artificial Sequence: Chemically synthesized oligonucleotide
tcttcctggggcagccaga

SEQ ID NO: 4556 - DNA, 19 bp, Artificial Sequence
  Description of Artificial Sequence: Chemically synthesized oligonucleotide
tctggctgccccaggaaga

SEQ ID NO: 4557 - DNA, 19 bp, Artificial Sequence
  Description of Artificial Sequence: Chemically synthesized oligonucleotide
cttcctggggcagccagac

SEQ ID NO: 4558 - DNA, 19 bp, Artificial Sequence
  Description of Artificial Sequence: Chemically synthesized oligonucleotide
gtctggctgccccaggaag

SEQ ID NO: 4559 - DNA, 19 bp, Artificial Sequence
  Description of Artificial Sequence: Chemically synthesized oligonucleotide
ttcctggggcagccagaca

SEQ ID NO: 4560 - DNA, 19 bp, Artificial Sequence
  Description of Artificial Sequence: Chemically synthesized oligonucleotide
tgtctggctgccccaggaa

SEQ ID NO: 4561 - DNA, 19 bp, Artificial Sequence
  Description of Artificial Sequence: Chemically synthesized oligonucleotide
tcctggggcagccagacac

SEQ ID NO: 4562 - DNA, 19 bp, Artificial Sequence
  Description of Artificial Sequence: Chemically synthesized oligonucleotide
gtgtctggctgccccagga

SEQ ID NO: 4563 - DNA, 19 bp, Artificial Sequence
  Description of Artificial Sequence: Chemically synthesized oligonucleotide
cctggggcagccagacact

SEQ ID NO: 4564 - DNA, 19 bp, Artificial Sequence
  Description of Artificial Sequence: Chemically synthesized oligonucleotide
agtgtctggctgccccagg

SEQ ID NO: 4565 - DNA, 19 bp, Artificial Sequence
  Description of Artificial Sequence: Chemically synthesized oligonucleotide
ctggggcagccagacactg

SEQ ID NO: 4566 - DNA, 19 bp, Artificial Sequence
  Description of Artificial Sequence: Chemically synthesized oligonucleotide
cagtgtctggctgccccag

SEQ ID NO: 4567 - DNA, 19 bp, Artificial Sequence
  Description of Artificial Sequence: Chemically synthesized oligonucleotide
tggggcagccagacactgt

SEQ ID NO: 4568 - DNA, 19 bp, Artificial Sequence
  Description of Artificial Sequence: Chemically synthesized oligonucleotide
acagtgtctggctgcccca

SEQ ID NO: 4569 - DNA, 19 bp, Artificial Sequence
  Description of Artificial Sequence: Chemically synthesized oligonucleotide
ggggcagccagacactgtg

SEQ ID NO: 4570 - DNA, 19 bp, Artificial Sequence
  Description of Artificial Sequence: Chemically synthesized oligonucleotide
cacagtgtctggctgcccc

SEQ ID NO: 4571 - DNA, 19 bp, Artificial Sequence
  Description of Artificial Sequence: Chemically synthesized oligonucleotide
gggcagccagacactgtgc

SEQ ID NO: 4572 - DNA, 19 bp, Artificial Sequence
  Description of Artificial Sequence: Chemically synthesized oligonucleotide
gcacagtgtctggctgccc

SEQ ID NO: 4573 - DNA, 19 bp, Artificial Sequence
  Description of Artificial Sequence: Chemically synthesized oligonucleotide
ggcagccagacactgtgcc

SEQ ID NO: 4574 - DNA, 19 bp, Artificial Sequence
  Description of Artificial Sequence: Chemically synthesized oligonucleotide
ggcacagtgtctggctgcc

SEQ ID NO: 4575 - DNA, 19 bp, Artificial Sequence
  Description of Artificial Sequence: Chemically synthesized oligonucleotide
gcagccagacactgtgccc

SEQ ID NO: 4576 - DNA, 19 bp, Artificial Sequence
  Description of Artificial Sequence: Chemically synthesized oligonucleotide
gggcacagtgtctggctgc

SEQ ID NO: 4577 - DNA, 19 bp, Artificial Sequence
  Description of Artificial Sequence: Chemically synthesized oligonucleotide
cagccagacactgtgccct

SEQ ID NO: 4578 - DNA, 19 bp, Artificial Sequence
  Description of Artificial Sequence: Chemically synthesized oligonucleotide
agggcacagtgtctggctg

SEQ ID NO: 4579 - DNA, 19 bp, Artificial Sequence
  Description of Artificial Sequence: Chemically synthesized oligonucleotide
agccagacactgtgccctg

SEQ ID NO: 4580 - DNA, 19 bp, Artificial Sequence
  Description of Artificial Sequence: Chemically synthesized oligonucleotide
cagggcacagtgtctggct

SEQ ID NO: 4581 - DNA, 19 bp, Artificial Sequence
  Description of Artificial Sequence: Chemically synthesized oligonucleotide
gccagacactgtgccctgg

SEQ ID NO: 4582 - DNA, 19 bp, Artificial Sequence
  Description of Artificial Sequence: Chemically synthesized oligonucleotide
ccagggcacagtgtctggc

SEQ ID NO: 4583 - DNA, 19 bp, Artificial Sequence
  Description of Artificial Sequence: Chemically synthesized oligonucleotide
ccagacactgtgccctgga

SEQ ID NO: 4584 - DNA, 19 bp, Artificial Sequence
  Description of Artificial Sequence: Chemically synthesized oligonucleotide
tccagggcacagtgtctgg

SEQ ID NO: 4585 - DNA, 19 bp, Artificial Sequence
  Description of Artificial Sequence: Chemically synthesized oligonucleotide
cagacactgtgccctggac

SEQ ID NO: 4586 - DNA, 19 bp, Artificial Sequence
  Description of Artificial Sequence: Chemically synthesized oligonucleotide
gtccagggcacagtgtctg

SEQ ID NO: 4587 - DNA, 19 bp, Artificial Sequence
  Description of Artificial Sequence: Chemically synthesized oligonucleotide
agacactgtgccctggacc

SEQ ID NO: 4588 - DNA, 19 bp, Artificial Sequence
  Description of Artificial Sequence: Chemically synthesized oligonucleotide
ggtccagggcacagtgtct

SEQ ID NO: 4589 - DNA, 19 bp, Artificial Sequence
  Description of Artificial Sequence: Chemically synthesized oligonucleotide
gacactgtgccctggacct

SEQ ID NO: 4590 - DNA, 19 bp, Artificial Sequence
  Description of Artificial Sequence: Chemically synthesized oligonucleotide
aggtccagggcacagtgtc

SEQ ID NO: 4591 - DNA, 19 bp, Artificial Sequence
  Description of Artificial Sequence: Chemically synthesized oligonucleotide
acactgtgccctggacctc

SEQ ID NO: 4592 - DNA, 19 bp, Artificial Sequence
  Description of Artificial Sequence: Chemically synthesized oligonucleotide
gaggtccagggcacagtgt

SEQ ID NO: 4593 - DNA, 19 bp, Artificial Sequence
  Description of Artificial Sequence: Chemically synthesized oligonucleotide
cactgtgccctggacctcc

SEQ ID NO: 4594 - DNA, 19 bp, Artificial Sequence
  Description of Artificial Sequence: Chemically synthesized oligonucleotide
ggaggtccagggcacagtg

SEQ ID NO: 4595 - DNA, 19 bp, Artificial Sequence
  Description of Artificial Sequence: Chemically synthesized oligonucleotide
actgtgccctggacctcct

SEQ ID NO: 4596 - DNA, 19 bp, Artificial Sequence
  Description of Artificial Sequence: Chemically synthesized oligonucleotide
aggaggtccagggcacagt

SEQ ID NO: 4597 - DNA, 19 bp, Artificial Sequence
  Description of Artificial Sequence: Chemically synthesized oligonucleotide
ctgtgccctggacctcctg

SEQ ID NO: 4598 - DNA, 19 bp, Artificial Sequence
  Description of Artificial Sequence: Chemically synthesized oligonucleotide
caggaggtccagggcacag

SEQ ID NO: 4599 - DNA, 19 bp, Artificial Sequence
  Description of Artificial Sequence: Chemically synthesized oligonucleotide
tgtgccctggacctcctgg

SEQ ID NO: 4600 - DNA, 19 bp, Artificial Sequence
  Description of Artificial Sequence: Chemically synthesized oligonucleotide
ccaggaggtccagggcaca

SEQ ID NO: 4601 - DNA, 19 bp, Artificial Sequence
  Description of Artificial Sequence: Chemically synthesized oligonucleotide
gtgccctggacctcctggc

SEQ ID NO: 4602 - DNA, 19 bp, Artificial Sequence
  Description of Artificial Sequence: Chemically synthesized oligonucleotide
gccaggaggtccagggcac

SEQ ID NO: 4603 - DNA, 19 bp, Artificial Sequence
  Description of Artificial Sequence: Chemically synthesized oligonucleotide
tgccctggacctcctggcc

SEQ ID NO: 4604 - DNA, 19 bp, Artificial Sequence
  Description of Artificial Sequence: Chemically synthesized oligonucleotide
ggccaggaggtccagggca

SEQ ID NO: 4605 - DNA, 19 bp, Artificial Sequence
  Description of Artificial Sequence: Chemically synthesized oligonucleotide
gccctggacctcctggccc

SEQ ID NO: 4606 - DNA, 19 bp, Artificial Sequence
  Description of Artificial Sequence: Chemically synthesized oligonucleotide
gggccaggaggtccagggc

SEQ ID NO: 4607 - DNA, 19 bp, Artificial Sequence
  Description of Artificial Sequence: Chemically synthesized oligonucleotide
ccctggacctcctggcccg

SEQ ID NO: 4608 - DNA, 19 bp, Artificial Sequence
  Description of Artificial Sequence: Chemically synthesized oligonucleotide
cgggccaggaggtccaggg

SEQ ID NO: 4609 - DNA, 19 bp, Artificial Sequence
  Description of Artificial Sequence: Chemically synthesized oligonucleotide
cctggacctcctggcccgc

SEQ ID NO: 4610 - DNA, 19 bp, Artificial Sequence
  Description of Artificial Sequence: Chemically synthesized oligonucleotide
gcgggccaggaggtccagg

SEQ ID NO: 4611 - DNA, 19 bp, Artificial Sequence
  Description of Artificial Sequence: Chemically synthesized oligonucleotide
ctggacctcctggcccgct

SEQ ID NO: 4612 - DNA, 19 bp, Artificial Sequence
  Description of Artificial Sequence: Chemically synthesized oligonucleotide
agcgggccaggaggtccag

SEQ ID NO: 4613 - DNA, 19 bp, Artificial Sequence
  Description of Artificial Sequence: Chemically synthesized oligonucleotide
tggacctcctggcccgctt

SEQ ID NO: 4614 - DNA, 19 bp, Artificial Sequence
  Description of Artificial Sequence: Chemically synthesized oligonucleotide
aagcgggccaggaggtcca

SEQ ID NO: 4615 - DNA, 19 bp, Artificial Sequence
  Description of Artificial Sequence: Chemically synthesized oligonucleotide
ggacctcctggcccgcttg

SEQ ID NO: 4616 - DNA, 19 bp, Artificial Sequence
  Description of Artificial Sequence: Chemically synthesized oligonucleotide
caagcgggccaggaggtcc

SEQ ID NO: 4617 - DNA, 19 bp, Artificial Sequence
  Description of Artificial Sequence: Chemically synthesized oligonucleotide
gacctcctggcccgcttgt

SEQ ID NO: 4618 - DNA, 19 bp, Artificial Sequence
  Description of Artificial Sequence: Chemically synthesized oligonucleotide
acaagcgggccaggaggtc

SEQ ID NO: 4619 - DNA, 19 bp, Artificial Sequence
  Description of Artificial Sequence: Chemically synthesized oligonucleotide
acctcctggcccgcttgtc

SEQ ID NO: 4620 - DNA, 19 bp, Artificial Sequence
  Description of Artificial Sequence: Chemically synthesized oligonucleotide
gacaagcgggccaggaggt

SEQ ID NO: 4621 - DNA, 19 bp, Artificial Sequence
  Description of Artificial Sequence: Chemically synthesized oligonucleotide
cctcctggcccgcttgtcc

SEQ ID NO: 4622 - DNA, 19 bp, Artificial Sequence
  Description of Artificial Sequence: Chemically synthesized oligonucleotide
ggacaagcgggccaggagg

SEQ ID NO: 4623 - DNA, 19 bp, Artificial Sequence
  Description of Artificial Sequence: Chemically synthesized oligonucleotide
ctcctggcccgcttgtccc

SEQ ID NO: 4624 - DNA, 19 bp, Artificial Sequence
  Description of Artificial Sequence: Chemically synthesized oligonucleotide
gggacaagcgggccaggag

SEQ ID NO: 4625 - DNA, 19 bp, Artificial Sequence
  Description of Artificial Sequence: Chemically synthesized oligonucleotide
tcctggcccgcttgtcccc

SEQ ID NO: 4626 - DNA, 19 bp, Artificial Sequence
  Description of Artificial Sequence: Chemically synthesized oligonucleotide
ggggacaagcgggccagga

SEQ ID NO: 4627 - DNA, 19 bp, Artificial Sequence
  Description of Artificial Sequence: Chemically synthesized oligonucleotide
cctggcccgcttgtccccc

SEQ ID NO: 4628 - DNA, 19 bp, Artificial Sequence
  Description of Artificial Sequence: Chemically synthesized oligonucleotide
gggggacaagcgggccagg

SEQ ID NO: 4629 - DNA, 19 bp, Artificial Sequence
  Description of Artificial Sequence: Chemically synthesized oligonucleotide
ctggcccgcttgtccccca

SEQ ID NO: 4630 - DNA, 19 bp, Artificial Sequence
  Description of Artificial Sequence: Chemically synthesized oligonucleotide
tgggggacaagcgggccag

SEQ ID NO: 4631 - DNA, 19 bp, Artificial Sequence
  Description of Artificial Sequence: Chemically synthesized oligonucleotide
tggcccgcttgtcccccag

SEQ ID NO: 4632 - DNA, 19 bp, Artificial Sequence
  Description of Artificial Sequence: Chemically synthesized oligonucleotide
ctgggggacaagcgggcca

SEQ ID NO: 4633 - DNA, 19 bp, Artificial Sequence
  Description of Artificial Sequence: Chemically synthesized oligonucleotide
ggcccgcttgtcccccagg

SEQ ID NO: 4634 - DNA, 19 bp, Artificial Sequence
  Description of Artificial Sequence: Chemically synthesized oligonucleotide
cctgggggacaagcgggcc

SEQ ID NO: 4635 - DNA, 19 bp, Artificial Sequence
  Description of Artificial Sequence: Chemically synthesized oligonucleotide
gcccgcttgtcccccaggc

SEQ ID NO: 4636 - DNA, 19 bp, Artificial Sequence
  Description of Artificial Sequence: Chemically synthesized oligonucleotide
gcctgggggacaagcgggc

SEQ ID NO: 4637 - DNA, 19 bp, Artificial Sequence
  Description of Artificial Sequence: Chemically synthesized oligonucleotide
cccgcttgtcccccaggcc

SEQ ID NO: 4638 - DNA, 19 bp, Artificial Sequence
  Description of Artificial Sequence: Chemically synthesized oligonucleotide
ggcctgggggacaagcggg

SEQ ID NO: 4639 - DNA, 19 bp, Artificial Sequence
  Description of Artificial Sequence: Chemically synthesized oligonucleotide
ccgcttgtcccccaggcct

SEQ ID NO: 4640 - DNA, 19 bp, Artificial Sequence
  Description of Artificial Sequence: Chemically synthesized oligonucleotide
aggcctgggggacaagcgg

SEQ ID NO: 4641 - DNA, 19 bp, Artificial Sequence
  Description of Artificial Sequence: Chemically synthesized oligonucleotide
cgcttgtcccccaggcctt

SEQ ID NO: 4642 - DNA, 19 bp, Artificial Sequence
  Description of Artificial Sequence: Chemically synthesized oligonucleotide
aaggcctgggggacaagcg

SEQ ID NO: 4643 - DNA, 19 bp, Artificial Sequence
  Description of Artificial Sequence: Chemically synthesized oligonucleotide
gcttgtcccccaggccttg

SEQ ID NO: 4644 - DNA, 19 bp, Artificial Sequence
  Description of Artificial Sequence: Chemically synthesized oligonucleotide
caaggcctgggggacaagc

SEQ ID NO: 4645 - DNA, 19 bp, Artificial Sequence
  Description of Artificial Sequence: Chemically synthesized oligonucleotide
cttgtcccccaggccttgt

SEQ ID NO: 4646 - DNA, 19 bp, Artificial Sequence
  Description of Artificial Sequence: Chemically synthesized oligonucleotide
acaaggcctgggggacaag

SEQ ID NO: 4647 - DNA, 19 bp, Artificial Sequence
  Description of Artificial Sequence: Chemically synthesized oligonucleotide
ttgtcccccaggccttgtt

SEQ ID NO: 4648 - DNA, 19 bp, Artificial Sequence
  Description of Artificial Sequence: Chemically synthesized oligonucleotide
aacaaggcctgggggacaa

SEQ ID NO: 4649 - DNA, 19 bp, Artificial Sequence
  Description of Artificial Sequence: Chemically synthesized oligonucleotide
tgtcccccaggccttgttc

SEQ ID NO: 4650 - DNA, 19 bp, Artificial Sequence
  Description of Artificial Sequence: Chemically synthesized oligonucleotide
gaacaaggcctgggggaca

SEQ ID NO: 4651 - DNA, 19 bp, Artificial Sequence
  Description of Artificial Sequence: Chemically synthesized oligonucleotide
gtcccccaggccttgttca

SEQ ID NO: 4652 - DNA, 19 bp, Artificial Sequence
  Description of Artificial Sequence: Chemically synthesized oligonucleotide
tgaacaaggcctgggggac

SEQ ID NO: 4653 - DNA, 19 bp, Artificial Sequence
  Description of Artificial Sequence: Chemically synthesized oligonucleotide
tcccccaggccttgttcat

SEQ ID NO: 4654 - DNA, 19 bp, Artificial Sequence
  Description of Artificial Sequence: Chemically synthesized oligonucleotide
atgaacaaggcctggggga

SEQ ID NO: 4655 - DNA, 19 bp, Artificial Sequence
  Description of Artificial Sequence: Chemically synthesized oligonucleotide
cccccaggccttgttcata

SEQ ID NO: 4656 - DNA, 19 bp, Artificial Sequence
  Description of Artificial Sequence: Chemically synthesized oligonucleotide
tatgaacaaggcctggggg

SEQ ID NO: 4657 - DNA, 19 bp, Artificial Sequence
  Description of Artificial Sequence: Chemically synthesized oligonucleotide
ccccaggccttgttcatac

SEQ ID NO: 4658 - DNA, 19 bp, Artificial Sequence
  Description of Artificial Sequence: Chemically synthesized oligonucleotide
gtatgaacaaggcctgggg

SEQ ID NO: 4659 - DNA, 19 bp, Artificial Sequence
  Description of Artificial Sequence: Chemically synthesized oligonucleotide
cccaggccttgttcatact

SEQ ID NO: 4660 - DNA, 19 bp, Artificial Sequence
  Description of Artificial Sequence: Chemically synthesized oligonucleotide
agtatgaacaaggcctggg

SEQ ID NO: 4661 - DNA, 19 bp, Artificial Sequence
  Description of Artificial Sequence: Chemically synthesized oligonucleotide
ccaggccttgttcatactc

SEQ ID NO: 4662 - DNA, 19 bp, Artificial Sequence
  Description of Artificial Sequence: Chemically synthesized oligonucleotide
gagtatgaacaaggcctgg

SEQ ID NO: 4663 - DNA, 19 bp, Artificial Sequence
  Description of Artificial Sequence: Chemically synthesized oligonucleotide
caggccttgttcatactct

SEQ ID NO: 4664 - DNA, 19 bp, Artificial Sequence
  Description of Artificial Sequence: Chemically synthesized oligonucleotide
agagtatgaacaaggcctg

SEQ ID NO: 4665 - DNA, 19 bp, Artificial Sequence
  Description of Artificial Sequence: Chemically synthesized oligonucleotide
aggccttgttcatactctt

SEQ ID NO: 4666 - DNA, 19 bp, Artificial Sequence
  Description of Artificial Sequence: Chemically synthesized oligonucleotide
aagagtatgaacaaggcct

SEQ ID NO: 4667 - DNA, 19 bp, Artificial Sequence
  Description of Artificial Sequence: Chemically synthesized oligonucleotide
ggccttgttcatactcttg

SEQ ID NO: 4668 - DNA, 19 bp, Artificial Sequence
  Description of Artificial Sequence: Chemically synthesized oligonucleotide
caagagtatgaacaaggcc

SEQ ID NO: 4669 - DNA, 19 bp, Artificial Sequence
  Description of Artificial Sequence: Chemically synthesized oligonucleotide
gccttgttcatactcttgg

SEQ ID NO: 4670 - DNA, 19 bp, Artificial Sequence
  Description of Artificial Sequence: Chemically synthesized oligonucleotide
ccaagagtatgaacaaggc

SEQ ID NO: 4671 - DNA, 19 bp, Artificial Sequence
  Description of Artificial Sequence: Chemically synthesized oligonucleotide
ccttgttcatactcttggc

SEQ ID NO: 4672 - DNA, 19 bp, Artificial Sequence
  Description of Artificial Sequence: Chemically synthesized oligonucleotide
gccaagagtatgaacaagg

SEQ ID NO: 4673 - DNA, 19 bp, Artificial Sequence
  Description of Artificial Sequence: Chemically synthesized oligonucleotide
cttgttcatactcttggca

SEQ ID NO: 4674 - DNA, 19 bp, Artificial Sequence
  Description of Artificial Sequence: Chemically synthesized oligonucleotide
tgccaagagtatgaacaag

SEQ ID NO: 4675 - DNA, 19 bp, Artificial Sequence
  Description of Artificial Sequence: Chemically synthesized oligonucleotide
ttgttcatactcttggcaa

SEQ ID NO: 4676 - DNA, 19 bp, Artificial Sequence
  Description of Artificial Sequence: Chemically synthesized oligonucleotide
ttgccaagagtatgaacaa

SEQ ID NO: 4677 - DNA, 19 bp, Artificial Sequence
  Description of Artificial Sequence: Chemically synthesized oligonucleotide
tgttcatactcttggcaac

SEQ ID NO: 4678 - DNA, 19 bp, Artificial Sequence
  Description of Artificial Sequence: Chemically synthesized oligonucleotide
gttgccaagagtatgaaca

SEQ ID NO: 4679 - DNA, 19 bp, Artificial Sequence
  Description of Artificial Sequence: Chemically synthesized oligonucleotide
gttcatactcttggcaacg

SEQ ID NO: 4680 - DNA, 19 bp, Artificial Sequence
  Description of Artificial Sequence: Chemically synthesized oligonucleotide
cgttgccaagagtatgaac

SEQ ID NO: 4681 - DNA, 19 bp, Artificial Sequence
  Description of Artificial Sequence: Chemically synthesized oligonucleotide
ttcatactcttggcaacgt

SEQ ID NO: 4682 - DNA, 19 bp, Artificial Sequence
  Description of Artificial Sequence: Chemically synthesized oligonucleotide
acgttgccaagagtatgaa

SEQ ID NO: 4683 - DNA, 19 bp, Artificial Sequence
  Description of Artificial Sequence: Chemically synthesized oligonucleotide
tcatactcttggcaacgtc

SEQ ID NO: 4684 - DNA, 19 bp, Artificial Sequence
  Description of Artificial Sequence: Chemically synthesized oligonucleotide
gacgttgccaagagtatga

SEQ ID NO: 4685 - DNA, 19 bp, Artificial Sequence
  Description of Artificial Sequence: Chemically synthesized oligonucleotide
catactcttggcaacgtct

SEQ ID NO: 4686 - DNA, 19 bp, Artificial Sequence
  Description of Artificial Sequence: Chemically synthesized oligonucleotide
agacgttgccaagagtatg

SEQ ID NO: 4687 - DNA, 19 bp, Artificial Sequence
  Description of Artificial Sequence: Chemically synthesized oligonucleotide
atactcttggcaacgtctg

SEQ ID NO: 4688 - DNA, 19 bp, Artificial Sequence
  Description of Artificial Sequence: Chemically synthesized oligonucleotide
cagacgttgccaagagtat

SEQ ID NO: 4689 - DNA, 19 bp, Artificial Sequence
  Description of Artificial Sequence: Chemically synthesized oligonucleotide
tactcttggcaacgtctgg

SEQ ID NO: 4690 - DNA, 19 bp, Artificial Sequence
  Description of Artificial Sequence: Chemically synthesized oligonucleotide
ccagacgttgccaagagta

SEQ ID NO: 4691 - DNA, 19 bp, Artificial Sequence
  Description of Artificial Sequence: Chemically synthesized oligonucleotide
actcttggcaacgtctggg

SEQ ID NO: 4692 - DNA, 19 bp, Artificial Sequence
  Description of Artificial Sequence: Chemically synthesized oligonucleotide
cccagacgttgccaagagt

SEQ ID NO: 4693 - DNA, 19 bp, Artificial Sequence
  Description of Artificial Sequence: Chemically synthesized oligonucleotide
ctcttggcaacgtctgggc

SEQ ID NO: 4694 - DNA, 19 bp, Artificial Sequence
  Description of Artificial Sequence: Chemically synthesized oligonucleotide
gcccagacgttgccaagag

SEQ ID NO: 4695 - DNA, 19 bp, Artificial Sequence
  Description of Artificial Sequence: Chemically synthesized oligonucleotide
tcttggcaacgtctgggct

SEQ ID NO: 4696 - DNA, 19 bp, Artificial Sequence
  Description of Artificial Sequence: Chemically synthesized oligonucleotide
agcccagacgttgccaaga

SEQ ID NO: 4697 - DNA, 19 bp, Artificial Sequence
  Description of Artificial Sequence: Chemically synthesized oligonucleotide
cttggcaacgtctgggctg

SEQ ID NO: 4698 - DNA, 19 bp, Artificial Sequence
  Description of Artificial Sequence: Chemically synthesized oligonucleotide
cagcccagacgttgccaag

SEQ ID NO: 4699 - DNA, 19 bp, Artificial Sequence
  Description of Artificial Sequence: Chemically synthesized oligonucleotide
ttggcaacgtctgggctgg

SEQ ID NO: 4700 - DNA, 19 bp, Artificial Sequence
  Description of Artificial Sequence: Chemically synthesized oligonucleotide
ccagcccagacgttgccaa

SEQ ID NO: 4701 - DNA, 19 bp, Artificial Sequence
  Description of Artificial Sequence: Chemically synthesized oligonucleotide
tggcaacgtctgggctggg

SEQ ID NO: 4702 - DNA, 19 bp, Artificial Sequence
  Description of Artificial Sequence: Chemically synthesized oligonucleotide
cccagcccagacgttgcca

SEQ ID NO: 4703 - DNA, 19 bp, Artificial Sequence
  Description of Artificial Sequence: Chemically synthesized oligonucleotide
ggcaacgtctgggctgggc

SEQ ID NO: 4704 - DNA, 19 bp, Artificial Sequence
  Description of Artificial Sequence: Chemically synthesized oligonucleotide
gcccagcccagacgttgcc

SEQ ID NO: 4705 - DNA, 19 bp, Artificial Sequence
  Description of Artificial Sequence: Chemically synthesized oligonucleotide
gcaacgtctgggctgggcc

SEQ ID NO: 4706 - DNA, 19 bp, Artificial Sequence
  Description of Artificial Sequence: Chemically synthesized oligonucleotide
ggcccagcccagacgttgc

SEQ ID NO: 4707 - DNA, 19 bp, Artificial Sequence
  Description of Artificial Sequence: Chemically synthesized oligonucleotide
caacgtctgggctgggcca

SEQ ID NO: 4708 - DNA, 19 bp, Artificial Sequence
  Description of Artificial Sequence: Chemically synthesized oligonucleotide
tggcccagcccagacgttg

SEQ ID NO: 4709 - DNA, 19 bp, Artificial Sequence
  Description of Artificial Sequence: Chemically synthesized oligonucleotide
aacgtctgggctgggccag

SEQ ID NO: 4710 - DNA, 19 bp, Artificial Sequence
  Description of Artificial Sequence: Chemically synthesized oligonucleotide
ctggcccagcccagacgtt

SEQ ID NO: 4711 - DNA, 19 bp, Artificial Sequence
  Description of Artificial Sequence: Chemically synthesized oligonucleotide
acgtctgggctgggccagg

SEQ ID NO: 4712 - DNA, 19 bp, Artificial Sequence
  Description of Artificial Sequence: Chemically synthesized oligonucleotide
cctggcccagcccagacgt

SEQ ID NO: 4713 - DNA, 19 bp, Artificial Sequence
  Description of Artificial Sequence: Chemically synthesized oligonucleotide
cgtctgggctgggccaggc

SEQ ID NO: 4714 - DNA, 19 bp, Artificial Sequence
  Description of Artificial Sequence: Chemically synthesized oligonucleotide
gcctggcccagcccagacg

SEQ ID NO: 4715 - DNA, 19 bp, Artificial Sequence
  Description of Artificial Sequence: Chemically synthesized oligonucleotide
gtctgggctgggccaggcg

SEQ ID NO: 4716 - DNA, 19 bp, Artificial Sequence
  Description of Artificial Sequence: Chemically synthesized oligonucleotide
cgcctggcccagcccagac

SEQ ID NO: 4717 - DNA, 19 bp, Artificial Sequence
  Description of Artificial Sequence: Chemically synthesized oligonucleotide
tctgggctgggccaggcga

SEQ ID NO: 4718 - DNA, 19 bp, Artificial Sequence
  Description of Artificial Sequence: Chemically synthesized oligonucleotide
tcgcctggcccagcccaga

SEQ ID NO: 4719 - DNA, 19 bp, Artificial Sequence
  Description of Artificial Sequence: Chemically synthesized oligonucleotide
ctgggctgggccaggcgat

SEQ ID NO: 4720 - DNA, 19 bp, Artificial Sequence
  Description of Artificial Sequence: Chemically synthesized oligonucleotide
atcgcctggcccagcccag

SEQ ID NO: 4721 - DNA, 19 bp, Artificial Sequence
  Description of Artificial Sequence: Chemically synthesized oligonucleotide
tgggctgggccaggcgatg

SEQ ID NO: 4722 - DNA, 19 bp, Artificial Sequence
  Description of Artificial Sequence: Chemically synthesized oligonucleotide
catcgcctggcccagccca

SEQ ID NO: 4723 - DNA, 19 bp, Artificial Sequence
  Description of Artificial Sequence: Chemically synthesized oligonucleotide
gggctgggccaggcgatgg

SEQ ID NO: 4724 - DNA, 19 bp, Artificial Sequence
  Description of Artificial Sequence: Chemically synthesized oligonucleotide
ccatcgcctggcccagccc

SEQ ID NO: 4725 - DNA, 19 bp, Artificial Sequence
  Description of Artificial Sequence: Chemically synthesized oligonucleotide
ggctgggccaggcgatggg

SEQ ID NO: 4726 - DNA, 19 bp, Artificial Sequence
  Description of Artificial Sequence: Chemically synthesized oligonucleotide
cccatcgcctggcccagcc

SEQ ID NO: 4727 - DNA, 19 bp, Artificial Sequence
  Description of Artificial Sequence: Chemically synthesized oligonucleotide
gctgggccaggcgatggga

SEQ ID NO: 4728 - DNA, 19 bp, Artificial Sequence
  Description of Artificial Sequence: Chemically synthesized oligonucleotide
tcccatcgcctggcccagc

SEQ ID NO: 4729 - DNA, 19 bp, Artificial Sequence
  Description of Artificial Sequence: Chemically synthesized oligonucleotide
ctgggccaggcgatgggaa

SEQ ID NO: 4730 - DNA, 19 bp, Artificial Sequence
  Description of Artificial Sequence: Chemically synthesized oligonucleotide
ttcccatcgcctggcccag

SEQ ID NO: 4731 - DNA, 19 bp, Artificial Sequence
  Description of Artificial Sequence: Chemically synthesized oligonucleotide
tgggccaggcgatgggaac

SEQ ID NO: 4732 - DNA, 19 bp, Artificial Sequence
  Description of Artificial Sequence: Chemically synthesized oligonucleotide
gttcccatcgcctggccca

SEQ ID NO: 4733 - DNA, 19 bp, Artificial Sequence
  Description of Artificial Sequence: Chemically synthesized oligonucleotide
gggccaggcgatgggaacc

SEQ ID NO: 4734 - DNA, 19 bp, Artificial Sequence
  Description of Artificial Sequence: Chemically synthesized oligonucleotide
ggttcccatcgcctggccc

SEQ ID NO: 4735 - DNA, 19 bp, Artificial Sequence
  Description of Artificial Sequence: Chemically synthesized oligonucleotide
ggccaggcgatgggaacct

SEQ ID NO: 4736 - DNA, 19 bp, Artificial Sequence
  Description of Artificial Sequence: Chemically synthesized oligonucleotide
aggttcccatcgcctggcc

SEQ ID NO: 4737 - DNA, 19 bp, Artificial Sequence
  Description of Artificial Sequence: Chemically synthesized oligonucleotide
gccaggcgatgggaacctt

SEQ ID NO: 4738 - DNA, 19 bp, Artificial Sequence
  Description of Artificial Sequence: Chemically synthesized oligonucleotide
aaggttcccatcgcctggc

SEQ ID NO: 4739 - DNA, 19 bp, Artificial Sequence
  Description of Artificial Sequence: Chemically synthesized oligonucleotide
ccaggcgatgggaaccttg

SEQ ID NO: 4740 - DNA, 19 bp, Artificial Sequence
  Description of Artificial Sequence: Chemically synthesized oligonucleotide
caaggttcccatcgcctgg

SEQ ID NO: 4741 - DNA, 19 bp, Artificial Sequence
  Description of Artificial Sequence: Chemically synthesized oligonucleotide
caggcgatgggaaccttgg

SEQ ID NO: 4742 - DNA, 19 bp, Artificial Sequence
  Description of Artificial Sequence: Chemically synthesized oligonucleotide
ccaaggttcccatcgcctg

SEQ ID NO: 4743 - DNA, 19 bp, Artificial Sequence
  Description of Artificial Sequence: Chemically synthesized oligonucleotide
aggcgatgggaaccttggg

SEQ ID NO: 4744 - DNA, 19 bp, Artificial Sequence
  Description of Artificial Sequence: Chemically synthesized oligonucleotide
cccaaggttcccatcgcct

SEQ ID NO: 4745 - DNA, 19 bp, Artificial Sequence
  Description of Artificial Sequence: Chemically synthesized oligonucleotide
ggcgatgggaaccttgggt

SEQ ID NO: 4746 - DNA, 19 bp, Artificial Sequence
  Description of Artificial Sequence: Chemically synthesized oligonucleotide
acccaaggttcccatcgcc

SEQ ID NO: 4747 - DNA, 19 bp, Artificial Sequence
  Description of Artificial Sequence: Chemically synthesized oligonucleotide
gcgatgggaaccttgggta

SEQ ID NO: 4748 - DNA, 19 bp, Artificial Sequence
  Description of Artificial Sequence: Chemically synthesized oligonucleotide
tacccaaggttcccatcgc

SEQ ID NO: 4749 - DNA, 19 bp, Artificial Sequence
  Description of Artificial Sequence: Chemically synthesized oligonucleotide
cgatgggaaccttgggtac

SEQ ID NO: 4750 - DNA, 19 bp, Artificial Sequence
  Description of Artificial Sequence: Chemically synthesized oligonucleotide
gtacccaaggttcccatcg

SEQ ID NO: 4751 - DNA, 19 bp, Artificial Sequence
  Description of Artificial Sequence: Chemically synthesized oligonucleotide
gatgggaaccttgggtacc

SEQ ID NO: 4752 - DNA, 19 bp, Artificial Sequence
  Description of Artificial Sequence: Chemically synthesized oligonucleotide
ggtacccaaggttcccatc

SEQ ID NO: 4753 - DNA, 19 bp, Artificial Sequence
  Description of Artificial Sequence: Chemically synthesized oligonucleotide
atgggaaccttgggtacca

SEQ ID NO: 4754 - DNA, 19 bp, Artificial Sequence
  Description of Artificial Sequence: Chemically synthesized oligonucleotide
tggtacccaaggttcccat

SEQ ID NO: 4755 - DNA, 19 bp, Artificial Sequence
  Description of Artificial Sequence: Chemically synthesized oligonucleotide
tgggaaccttgggtaccag

SEQ ID NO: 4756 - DNA, 19 bp, Artificial Sequence
  Description of Artificial Sequence: Chemically synthesized oligonucleotide
ctggtacccaaggttccca

SEQ ID NO: 4757 - DNA, 19 bp, Artificial Sequence
  Description of Artificial Sequence: Chemically synthesized oligonucleotide
gggaaccttgggtaccagc

SEQ ID NO: 4758 - DNA, 19 bp, Artificial Sequence
  Description of Artificial Sequence: Chemically synthesized oligonucleotide
gctggtacccaaggttccc

SEQ ID NO: 4759 - DNA, 19 bp, Artificial Sequence
  Description of Artificial Sequence: Chemically synthesized oligonucleotide
ggaaccttgggtaccagct

SEQ ID NO: 4760 - DNA, 19 bp, Artificial Sequence
  Description of Artificial Sequence: Chemically synthesized oligonucleotide
agctggtacccaaggttcc

SEQ ID NO: 4761 - DNA, 19 bp, Artificial Sequence
  Description of Artificial Sequence: Chemically synthesized oligonucleotide
gaaccttgggtaccagctg

SEQ ID NO: 4762 - DNA, 19 bp, Artificial Sequence
  Description of Artificial Sequence: Chemically synthesized oligonucleotide
cagctggtacccaaggttc

SEQ ID NO: 4763 - DNA, 19 bp, Artificial Sequence
  Description of Artificial Sequence: Chemically synthesized oligonucleotide
aaccttgggtaccagctgg

SEQ ID NO: 4764 - DNA, 19 bp, Artificial Sequence
  Description of Artificial Sequence: Chemically synthesized oligonucleotide
ccagctggtacccaaggtt

SEQ ID NO: 4765 - DNA, 19 bp, Artificial Sequence
  Description of Artificial Sequence: Chemically synthesized oligonucleotide
accttgggtaccagctggg

SEQ ID NO: 4766 - DNA, 19 bp, Artificial Sequence
  Description of Artificial Sequence: Chemically synthesized oligonucleotide
cccagctggtacccaaggt

SEQ ID NO: 4767 - DNA, 19 bp, Artificial Sequence
  Description of Artificial Sequence: Chemically synthesized oligonucleotide
ccttgggtaccagctgggg

SEQ ID NO: 4768 - DNA, 19 bp, Artificial Sequence
  Description of Artificial Sequence: Chemically synthesized oligonucleotide
ccccagctggtacccaagg

SEQ ID NO: 4769 - DNA, 19 bp, Artificial Sequence
  Description of Artificial Sequence: Chemically synthesized oligonucleotide
cttgggtaccagctggggc

SEQ ID NO: 4770 - DNA, 19 bp, Artificial Sequence
  Description of Artificial Sequence: Chemically synthesized oligonucleotide
gccccagctggtacccaag

SEQ ID NO: 4771 - DNA, 19 bp, Artificial Sequence
  Description of Artificial Sequence: Chemically synthesized oligonucleotide
ttgggtaccagctggggcc

SEQ ID NO: 4772 - DNA, 19 bp, Artificial Sequence
  Description of Artificial Sequence: Chemically synthesized oligonucleotide
ggccccagctggtacccaa

SEQ ID NO: 4773 - DNA, 19 bp, Artificial Sequence
  Description of Artificial Sequence: Chemically synthesized oligonucleotide
tgggtaccagctggggcca

SEQ ID NO: 4774 - DNA, 19 bp, Artificial Sequence
  Description of Artificial Sequence: Chemically synthesized oligonucleotide
tggccccagctggtaccca

SEQ ID NO: 4775 - DNA, 19 bp, Artificial Sequence
  Description of Artificial Sequence: Chemically synthesized oligonucleotide
gggtaccagctggggccac

SEQ ID NO: 4776 - DNA, 19 bp, Artificial Sequence
  Description of Artificial Sequence: Chemically synthesized oligonucleotide
gtggccccagctggtaccc

SEQ ID NO: 4777 - DNA, 19 bp, Artificial Sequence
  Description of Artificial Sequence: Chemically synthesized oligonucleotide
ggtaccagctggggccacc

SEQ ID NO: 4778 - DNA, 19 bp, Artificial Sequence
  Description of Artificial Sequence: Chemically synthesized oligonucleotide
ggtggccccagctggtacc

SEQ ID NO: 4779 - DNA, 19 bp, Artificial Sequence
  Description of Artificial Sequence: Chemically synthesized oligonucleotide
gtaccagctggggccacca

SEQ ID NO: 4780 - DNA, 19 bp, Artificial Sequence
  Description of Artificial Sequence: Chemically synthesized oligonucleotide
tggtggccccagctggtac

SEQ ID NO: 4781 - DNA, 19 bp, Artificial Sequence
  Description of Artificial Sequence: Chemically synthesized oligonucleotide
taccagctggggccaccag

SEQ ID NO: 4782 - DNA, 19 bp, Artificial Sequence
  Description of Artificial Sequence: Chemically synthesized oligonucleotide
ctggtggccccagctggta

SEQ ID NO: 4783 - DNA, 19 bp, Artificial Sequence
  Description of Artificial Sequence: Chemically synthesized oligonucleotide
accagctggggccaccagc

SEQ ID NO: 4784 - DNA, 19 bp, Artificial Sequence
  Description of Artificial Sequence: Chemically synthesized oligonucleotide
gctggtggccccagctggt

SEQ ID NO: 4785 - DNA, 19 bp, Artificial Sequence
  Description of Artificial Sequence: Chemically synthesized oligonucleotide
ccagctggggccaccagca

SEQ ID NO: 4786 - DNA, 19 bp, Artificial Sequence
  Description of Artificial Sequence: Chemically synthesized oligonucleotide
tgctggtggccccagctgg

SEQ ID NO: 4787 - DNA, 19 bp, Artificial Sequence
  Description of Artificial Sequence: Chemically synthesized oligonucleotide
cagctggggccaccagcaa

SEQ ID NO: 4788 - DNA, 19 bp, Artificial Sequence
  Description of Artificial Sequence: Chemically synthesized oligonucleotide
ttgctggtggccccagctg

SEQ ID NO: 4789 - DNA, 19 bp, Artificial Sequence
  Description of Artificial Sequence: Chemically synthesized oligonucleotide
agctggggccaccagcaac

SEQ ID NO: 4790 - DNA, 19 bp, Artificial Sequence
  Description of Artificial Sequence: Chemically synthesized oligonucleotide
gttgctggtggccccagct

SEQ ID NO: 4791 - DNA, 19 bp, Artificial Sequence
  Description of Artificial Sequence: Chemically synthesized oligonucleotide
gctggggccaccagcaaca

SEQ ID NO: 4792 - DNA, 19 bp, Artificial Sequence
  Description of Artificial Sequence: Chemically synthesized oligonucleotide
tgttgctggtggccccagc

SEQ ID NO: 4793 - DNA, 19 bp, Artificial Sequence
  Description of Artificial Sequence: Chemically synthesized oligonucleotide
ctggggccaccagcaacac

SEQ ID NO: 4794 - DNA, 19 bp, Artificial Sequence
  Description of Artificial Sequence: Chemically synthesized oligonucleotide
gtgttgctggtggccccag

SEQ ID NO: 4795 - DNA, 19 bp, Artificial Sequence
  Description of Artificial Sequence: Chemically synthesized oligonucleotide
tggggccaccagcaacacc

SEQ ID NO: 4796 - DNA, 19 bp, Artificial Sequence
  Description of Artificial Sequence: Chemically synthesized oligonucleotide
ggtgttgctggtggcccca

SEQ ID NO: 4797 - DNA, 19 bp, Artificial Sequence
  Description of Artificial Sequence: Chemically synthesized oligonucleotide
ggggccaccagcaacacca

SEQ ID NO: 4798 - DNA, 19 bp, Artificial Sequence
  Description of Artificial Sequence: Chemically synthesized oligonucleotide
tggtgttgctggtggcccc

SEQ ID NO: 4799 - DNA, 19 bp, Artificial Sequence
  Description of Artificial Sequence: Chemically synthesized oligonucleotide
gggccaccagcaacaccaa

SEQ ID NO: 4800 - DNA, 19 bp, Artificial Sequence
  Description of Artificial Sequence: Chemically synthesized oligonucleotide
ttggtgttgctggtggccc

SEQ ID NO: 4801 - DNA, 19 bp, Artificial Sequence
  Description of Artificial Sequence: Chemically synthesized oligonucleotide
ggccaccagcaacaccaag

SEQ ID NO: 4802 - DNA, 19 bp, Artificial Sequence
  Description of Artificial Sequence: Chemically synthesized oligonucleotide
cttggtgttgctggtggcc

SEQ ID NO: 4803 - DNA, 19 bp, Artificial Sequence
  Description of Artificial Sequence: Chemically synthesized oligonucleotide
gccaccagcaacaccaagg

SEQ ID NO: 4804 - DNA, 19 bp, Artificial Sequence
  Description of Artificial Sequence: Chemically synthesized oligonucleotide
ccttggtgttgctggtggc

SEQ ID NO: 4805 - DNA, 19 bp, Artificial Sequence
  Description of Artificial Sequence: Chemically synthesized oligonucleotide
ccaccagcaacaccaaggt

SEQ ID NO: 4806 - DNA, 19 bp, Artificial Sequence
  Description of Artificial Sequence: Chemically synthesized oligonucleotide
accttggtgttgctggtgg

SEQ ID NO: 4807 - DNA, 19 bp, Artificial Sequence
  Description of Artificial Sequence: Chemically synthesized oligonucleotide
caccagcaacaccaaggtg

SEQ ID NO: 4808 - DNA, 19 bp, Artificial Sequence
  Description of Artificial Sequence: Chemically synthesized oligonucleotide
caccttggtgttgctggtg

SEQ ID NO: 4809 - DNA, 19 bp, Artificial Sequence
  Description of Artificial Sequence: Chemically synthesized oligonucleotide
accagcaacaccaaggtgc

SEQ ID NO: 4810 - DNA, 19 bp, Artificial Sequence
  Description of Artificial Sequence: Chemically synthesized oligonucleotide
gcaccttggtgttgctggt

SEQ ID NO: 4811 - DNA, 19 bp, Artificial Sequence
  Description of Artificial Sequence: Chemically synthesized oligonucleotide
ccagcaacaccaaggtgcc

SEQ ID NO: 4812 - DNA, 19 bp, Artificial Sequence
  Description of Artificial Sequence: Chemically synthesized oligonucleotide
ggcaccttggtgttgctgg

SEQ ID NO: 4813 - DNA, 19 bp, Artificial Sequence
  Description of Artificial Sequence: Chemically synthesized oligonucleotide
cagcaacaccaaggtgccc

SEQ ID NO: 4814 - DNA, 19 bp, Artificial Sequence
  Description of Artificial Sequence: Chemically synthesized oligonucleotide
gggcaccttggtgttgctg

SEQ ID NO: 4815 - DNA, 19 bp, Artificial Sequence
  Description of Artificial Sequence: Chemically synthesized oligonucleotide
agcaacaccaaggtgcccc

SEQ ID NO: 4816 - DNA, 19 bp, Artificial Sequence
  Description of Artificial Sequence: Chemically synthesized oligonucleotide
ggggcaccttggtgttgct

SEQ ID NO: 4817 - DNA, 19 bp, Artificial Sequence
  Description of Artificial Sequence: Chemically synthesized oligonucleotide
gcaacaccaaggtgcccct

SEQ ID NO: 4818 - DNA, 19 bp, Artificial Sequence
  Description of Artificial Sequence: Chemically synthesized oligonucleotide
aggggcaccttggtgttgc

SEQ ID NO: 4819 - DNA, 19 bp, Artificial Sequence
  Description of Artificial Sequence: Chemically synthesized oligonucleotide
caacaccaaggtgcccctc

SEQ ID NO: 4820 - DNA, 19 bp, Artificial Sequence
  Description of Artificial Sequence: Chemically synthesized oligonucleotide
gaggggcaccttggtgttg

SEQ ID NO: 4821 - DNA, 19 bp, Artificial Sequence
  Description of Artificial Sequence: Chemically synthesized oligonucleotide
aacaccaaggtgcccctct

SEQ ID NO: 4822 - DNA, 19 bp, Artificial Sequence
  Description of Artificial Sequence: Chemically synthesized oligonucleotide
agaggggcaccttggtgtt

SEQ ID NO: 4823 - DNA, 19 bp, Artificial Sequence
  Description of Artificial Sequence: Chemically synthesized oligonucleotide
acaccaaggtgcccctctc

SEQ ID NO: 4824 - DNA, 19 bp, Artificial Sequence
  Description of Artificial Sequence: Chemically synthesized oligonucleotide
gagaggggcaccttggtgt

SEQ ID NO: 4825 - DNA, 19 bp, Artificial Sequence
  Description of Artificial Sequence: Chemically synthesized oligonucleotide
caccaaggtgcccctctcc

SEQ ID NO: 4826 - DNA, 19 bp, Artificial Sequence
  Description of Artificial Sequence: Chemically synthesized oligonucleotide
ggagaggggcaccttggtg

SEQ ID NO: 4827 - DNA, 19 bp, Artificial Sequence
  Description of Artificial Sequence: Chemically synthesized oligonucleotide
accaaggtgcccctctcct

SEQ ID NO: 4828 - DNA, 19 bp, Artificial Sequence
  Description of Artificial Sequence: Chemically synthesized oligonucleotide
aggagaggggcaccttggt

SEQ ID NO: 4829 - DNA, 19 bp, Artificial Sequence
  Description of Artificial Sequence: Chemically synthesized oligonucleotide
ccaaggtgcccctctcctg

SEQ ID NO: 4830 - DNA, 19 bp, Artificial Sequence
  Description of Artificial Sequence: Chemically synthesized oligonucleotide
caggagaggggcaccttgg

SEQ ID NO: 4831 - DNA, 19 bp, Artificial Sequence
  Description of Artificial Sequence: Chemically synthesized oligonucleotide
caaggtgcccctctcctga

SEQ ID NO: 4832 - DNA, 19 bp, Artificial Sequence
  Description of Artificial Sequence: Chemically synthesized oligonucleotide
tcaggagaggggcaccttg

SEQ ID NO: 4833 - DNA, 19 bp, Artificial Sequence
  Description of Artificial Sequence: Chemically synthesized oligonucleotide
aaggtgcccctctcctgag

SEQ ID NO: 4834 - DNA, 19 bp, Artificial Sequence
  Description of Artificial Sequence: Chemically synthesized oligonucleotide
ctcaggagaggggcacctt

SEQ ID NO: 4835 - DNA, 19 bp, Artificial Sequence
  Description of Artificial Sequence: Chemically synthesized oligonucleotide
aggtgcccctctcctgagc

SEQ ID NO: 4836 - DNA, 19 bp, Artificial Sequence
  Description of Artificial Sequence: Chemically synthesized oligonucleotide
gctcaggagaggggcacct

SEQ ID NO: 4837 - DNA, 19 bp, Artificial Sequence
  Description of Artificial Sequence: Chemically synthesized oligonucleotide
ggtgcccctctcctgagcc

SEQ ID NO: 4838 - DNA, 19 bp, Artificial Sequence
  Description of Artificial Sequence: Chemically synthesized oligonucleotide
ggctcaggagaggggcacc

SEQ ID NO: 4839 - DNA, 19 bp, Artificial Sequence
  Description of Artificial Sequence: Chemically synthesized oligonucleotide
gtgcccctctcctgagccg

SEQ ID NO: 4840 - DNA, 19 bp, Artificial Sequence
  Description of Artificial Sequence: Chemically synthesized oligonucleotide
cggctcaggagaggggcac

SEQ ID NO: 4841 - DNA, 19 bp, Artificial Sequence
  Description of Artificial Sequence: Chemically synthesized oligonucleotide
tgcccctctcctgagccgc

SEQ ID NO: 4842 - DNA, 19 bp, Artificial Sequence
  Description of Artificial Sequence: Chemically synthesized oligonucleotide
gcggctcaggagaggggca

SEQ ID NO: 4843 - DNA, 19 bp, Artificial Sequence
  Description of Artificial Sequence: Chemically synthesized oligonucleotide
gcccctctcctgagccgcc

SEQ ID NO: 4844 - DNA, 19 bp, Artificial Sequence
  Description of Artificial Sequence: Chemically synthesized oligonucleotide
ggcggctcaggagaggggc

SEQ ID NO: 4845 - DNA, 19 bp, Artificial Sequence
  Description of Artificial Sequence: Chemically synthesized oligonucleotide
cccctctcctgagccgcct

SEQ ID NO: 4846 - DNA, 19 bp, Artificial Sequence
  Description of Artificial Sequence: Chemically synthesized oligonucleotide
aggcggctcaggagagggg

SEQ ID NO: 4847 - DNA, 19 bp, Artificial Sequence
  Description of Artificial Sequence: Chemically synthesized oligonucleotide
ccctctcctgagccgcctg

SEQ ID NO: 4848 - DNA, 19 bp, Artificial Sequence
  Description of Artificial Sequence: Chemically synthesized oligonucleotide
caggcggctcaggagaggg

SEQ ID NO: 4849 - DNA, 19 bp, Artificial Sequence
  Description of Artificial Sequence: Chemically synthesized oligonucleotide
cctctcctgagccgcctgt

SEQ ID NO: 4850 - DNA, 19 bp, Artificial Sequence
  Description of Artificial Sequence: Chemically synthesized oligonucleotide
acaggcggctcaggagagg

SEQ ID NO: 4851 - DNA, 19 bp, Artificial Sequence
  Description of Artificial Sequence: Chemically synthesized oligonucleotide
ctctcctgagccgcctgtc

SEQ ID NO: 4852 - DNA, 19 bp, Artificial Sequence
  Description of Artificial Sequence: Chemically synthesized oligonucleotide
gacaggcggctcaggagag

SEQ ID NO: 4853 - DNA, 19 bp, Artificial Sequence
  Description of Artificial Sequence: Chemically synthesized oligonucleotide
tctcctgagccgcctgtca

SEQ ID NO: 4854 - DNA, 19 bp, Artificial Sequence
  Description of Artificial Sequence: Chemically synthesized oligonucleotide
tgacaggcggctcaggaga

SEQ ID NO: 4855 - DNA, 19 bp, Artificial Sequence
  Description of Artificial Sequence: Chemically synthesized oligonucleotide
ctcctgagccgcctgtcac

SEQ ID NO: 4856 - DNA, 19 bp, Artificial Sequence
  Description of Artificial Sequence: Chemically synthesized oligonucleotide
gtgacaggcggctcaggag

SEQ ID NO: 4857 - DNA, 19 bp, Artificial Sequence
  Description of Artificial Sequence: Chemically synthesized oligonucleotide
tcctgagccgcctgtcacc

SEQ ID NO: 4858 - DNA, 19 bp, Artificial Sequence
  Description of Artificial Sequence: Chemically synthesized oligonucleotide
ggtgacaggcggctcagga

SEQ ID NO: 4859 - DNA, 19 bp, Artificial Sequence
  Description of Artificial Sequence: Chemically synthesized oligonucleotide
cctgagccgcctgtcaccc

SEQ ID NO: 4860 - DNA, 19 bp, Artificial Sequence
  Description of Artificial Sequence: Chemically synthesized oligonucleotide
gggtgacaggcggctcagg

SEQ ID NO: 4861 - DNA, 19 bp, Artificial Sequence
  Description of Artificial Sequence: Chemically synthesized oligonucleotide
ctgagccgcctgtcaccca

SEQ ID NO: 4862 - DNA, 19 bp, Artificial Sequence
  Description of Artificial Sequence: Chemically synthesized oligonucleotide
tgggtgacaggcggctcag

SEQ ID NO: 4863 - DNA, 19 bp, Artificial Sequence
  Description of Artificial Sequence: Chemically synthesized oligonucleotide
tgagccgcctgtcacccag

SEQ ID NO: 4864 - DNA, 19 bp, Artificial Sequence
  Description of Artificial Sequence: Chemically synthesized oligonucleotide
ctgggtgacaggcggctca

SEQ ID NO: 4865 - DNA, 19 bp, Artificial Sequence
  Description of Artificial Sequence: Chemically synthesized oligonucleotide
gagccgcctgtcacccagc

SEQ ID NO: 4866 - DNA, 19 bp, Artificial Sequence
  Description of Artificial Sequence: Chemically synthesized oligonucleotide
gctgggtgacaggcggctc

SEQ ID NO: 4867 - DNA, 19 bp, Artificial Sequence
  Description of Artificial Sequence: Chemically synthesized oligonucleotide
agccgcctgtcacccagcg

SEQ ID NO: 4868 - DNA, 19 bp, Artificial Sequence
  Description of Artificial Sequence: Chemically synthesized oligonucleotide
cgctgggtgacaggcggct

SEQ ID NO: 4869 - DNA, 19 bp, Artificial Sequence
  Description of Artificial Sequence: Chemically synthesized oligonucleotide
gccgcctgtcacccagcgg

SEQ ID NO: 4870 - DNA, 19 bp, Artificial Sequence
  Description of Artificial Sequence: Chemically synthesized oligonucleotide
ccgctgggtgacaggcggc

SEQ ID NO: 4871 - DNA, 19 bp, Artificial Sequence
  Description of Artificial Sequence: Chemically synthesized oligonucleotide
ccgcctgtcacccagcggg

SEQ ID NO: 4872 - DNA, 19 bp, Artificial Sequence
  Description of Artificial Sequence: Chemically synthesized oligonucleotide
cccgctgggtgacaggcgg

SEQ ID NO: 4873 - DNA, 19 bp, Artificial Sequence
  Description of Artificial Sequence: Chemically synthesized oligonucleotide
cgcctgtcacccagcgggg

SEQ ID NO: 4874 - DNA, 19 bp, Artificial Sequence
  Description of Artificial Sequence: Chemically synthesized oligonucleotide
ccccgctgggtgacaggcg

SEQ ID NO: 4875 - DNA, 19 bp, Artificial Sequence
  Description of Artificial Sequence: Chemically synthesized oligonucleotide
gcctgtcacccagcggggc

SEQ ID NO: 4876 - DNA, 19 bp, Artificial Sequence
  Description of Artificial Sequence: Chemically synthesized oligonucleotide
gccccgctgggtgacaggc

SEQ ID NO: 4877 - DNA, 19 bp, Artificial Sequence
  Description of Artificial Sequence: Chemically synthesized oligonucleotide
cctgtcacccagcggggct

SEQ ID NO: 4878 - DNA, 19 bp, Artificial Sequence
  Description of Artificial Sequence: Chemically synthesized oligonucleotide
agccccgctgggtgacagg

SEQ ID NO: 4879 - DNA, 19 bp, Artificial Sequence
  Description of Artificial Sequence: Chemically synthesized oligonucleotide
ctgtcacccagcggggctg

SEQ ID NO: 4880 - DNA, 19 bp, Artificial Sequence
  Description of Artificial Sequence: Chemically synthesized oligonucleotide
cagccccgctgggtgacag

SEQ ID NO: 4881 - DNA, 19 bp, Artificial Sequence
  Description of Artificial Sequence: Chemically synthesized oligonucleotide
tgtcacccagcggggctgc

SEQ ID NO: 4882 - DNA, 19 bp, Artificial Sequence
  Description of Artificial Sequence: Chemically synthesized oligonucleotide
gcagccccgctgggtgaca

SEQ ID NO: 4883 - DNA, 19 bp, Artificial Sequence
  Description of Artificial Sequence: Chemically synthesized oligonucleotide
gtcacccagcggggctgct

SEQ ID NO: 4884 - DNA, 19 bp, Artificial Sequence
  Description of Artificial Sequence: Chemically synthesized oligonucleotide
agcagccccgctgggtgac

SEQ ID NO: 4885 - DNA, 19 bp, Artificial Sequence
  Description of Artificial Sequence: Chemically synthesized oligonucleotide
tcacccagcggggctgctg

SEQ ID NO: 4886 - DNA, 19 bp, Artificial Sequence
  Description of Artificial Sequence: Chemically synthesized oligonucleotide
cagcagccccgctgggtga

SEQ ID NO: 4887 - DNA, 19 bp, Artificial Sequence
  Description of Artificial Sequence: Chemically synthesized oligonucleotide
cacccagcggggctgctgt

SEQ ID NO: 4888 - DNA, 19 bp, Artificial Sequence
  Description of Artificial Sequence: Chemically synthesized oligonucleotide
acagcagccccgctgggtg

SEQ ID NO: 4889 - DNA, 19 bp, Artificial Sequence
  Description of Artificial Sequence: Chemically synthesized oligonucleotide
acccagcggggctgctgtt

SEQ ID NO: 4890 - DNA, 19 bp, Artificial Sequence
  Description of Artificial Sequence: Chemically synthesized oligonucleotide
aacagcagccccgctgggt

SEQ ID NO: 4891 - DNA, 19 bp, Artificial Sequence
  Description of Artificial Sequence: Chemically synthesized oligonucleotide
cccagcggggctgctgttc

SEQ ID NO: 4892 - DNA, 19 bp, Artificial Sequence
  Description of Artificial Sequence: Chemically synthesized oligonucleotide
gaacagcagccccgctggg

SEQ ID NO: 4893 - DNA, 19 bp, Artificial Sequence
  Description of Artificial Sequence: Chemically synthesized oligonucleotide
ccagcggggctgctgttca

SEQ ID NO: 4894 - DNA, 19 bp, Artificial Sequence
  Description of Artificial Sequence: Chemically synthesized oligonucleotide
tgaacagcagccccgctgg

SEQ ID NO: 4895 - DNA, 19 bp, Artificial Sequence
  Description of Artificial Sequence: Chemically synthesized oligonucleotide
cagcggggctgctgttcat

SEQ ID NO: 4896 - DNA, 19 bp, Artificial Sequence
  Description of Artificial Sequence: Chemically synthesized oligonucleotide
atgaacagcagccccgctg

SEQ ID NO: 4897 - DNA, 19 bp, Artificial Sequence
  Description of Artificial Sequence: Chemically synthesized oligonucleotide
agcggggctgctgttcatc

SEQ ID NO: 4898 - DNA, 19 bp, Artificial Sequence
  Description of Artificial Sequence: Chemically synthesized oligonucleotide
gatgaacagcagccccgct

SEQ ID NO: 4899 - DNA, 19 bp, Artificial Sequence
  Description of Artificial Sequence: Chemically synthesized oligonucleotide
gcggggctgctgttcatcc

SEQ ID NO: 4900 - DNA, 19 bp, Artificial Sequence
  Description of Artificial Sequence: Chemically synthesized oligonucleotide
ggatgaacagcagccccgc

SEQ ID NO: 4901 - DNA, 19 bp, Artificial Sequence
  Description of Artificial Sequence: Chemically synthesized oligonucleotide
cggggctgctgttcatcct

SEQ ID NO: 4902 - DNA, 19 bp, Artificial Sequence
  Description of Artificial Sequence: Chemically synthesized oligonucleotide
aggatgaacagcagccccg

SEQ ID NO: 4903 - DNA, 19 bp, Artificial Sequence
  Description of Artificial Sequence: Chemically synthesized oligonucleotide
ggggctgctgttcatccta

SEQ ID NO: 4904 - DNA, 19 bp, Artificial Sequence
  Description of Artificial Sequence: Chemically synthesized oligonucleotide
taggatgaacagcagcccc

SEQ ID NO: 4905 - DNA, 19 bp, Artificial Sequence
  Description of Artificial Sequence: Chemically synthesized oligonucleotide
gggctgctgttcatcctac

SEQ ID NO: 4906 - DNA, 19 bp, Artificial Sequence
  Description of Artificial Sequence: Chemically synthesized oligonucleotide
gtaggatgaacagcagccc

SEQ ID NO: 4907 - DNA, 19 bp, Artificial Sequence
  Description of Artificial Sequence: Chemically synthesized oligonucleotide
ggctgctgttcatcctacc

SEQ ID NO: 4908 - DNA, 19 bp, Artificial Sequence
  Description of Artificial Sequence: Chemically synthesized oligonucleotide
ggtaggatgaacagcagcc

SEQ ID NO: 4909 - DNA, 19 bp, Artificial Sequence
  Description of Artificial Sequence: Chemically synthesized oligonucleotide
gctgctgttcatcctaccc

SEQ ID NO: 4910 - DNA, 19 bp, Artificial Sequence
  Description of Artificial Sequence: Chemically synthesized oligonucleotide
gggtaggatgaacagcagc

SEQ ID NO: 4911 - DNA, 19 bp, Artificial Sequence
  Description of Artificial Sequence: Chemically synthesized oligonucleotide
ctgctgttcatcctaccca

SEQ ID NO: 4912 - DNA, 19 bp, Artificial Sequence
  Description of Artificial Sequence: Chemically synthesized oligonucleotide
tgggtaggatgaacagcag

SEQ ID NO: 4913 - DNA, 19 bp, Artificial Sequence
  Description of Artificial Sequence: Chemically synthesized oligonucleotide
tgctgttcatcctacccac

SEQ ID NO: 4914 - DNA, 19 bp, Artificial Sequence
  Description of Artificial Sequence: Chemically synthesized oligonucleotide
gtgggtaggatgaacagca

SEQ ID NO: 4915 - DNA, 19 bp, Artificial Sequence
  Description of Artificial Sequence: Chemically synthesized oligonucleotide
gctgttcatcctacccacc

SEQ ID NO: 4916 - DNA, 19 bp, Artificial Sequence
  Description of Artificial Sequence: Chemically synthesized oligonucleotide
ggtgggtaggatgaacagc

SEQ ID NO: 4917 - DNA, 19 bp, Artificial Sequence
  Description of Artificial Sequence: Chemically synthesized oligonucleotide
ctgttcatcctacccaccc

SEQ ID NO: 4918 - DNA, 19 bp, Artificial Sequence
  Description of Artificial Sequence: Chemically synthesized oligonucleotide
gggtgggtaggatgaacag

SEQ ID NO: 4919 - DNA, 19 bp, Artificial Sequence
  Description of Artificial Sequence: Chemically synthesized oligonucleotide
tgttcatcctacccaccca

SEQ ID NO: 4920 - DNA, 19 bp, Artificial Sequence
  Description of Artificial Sequence: Chemically synthesized oligonucleotide
tgggtgggtaggatgaaca

SEQ ID NO: 4921 - DNA, 19 bp, Artificial Sequence
  Description of Artificial Sequence: Chemically synthesized oligonucleotide
gttcatcctacccacccac

SEQ ID NO: 4922 - DNA, 19 bp, Artificial Sequence
  Description of Artificial Sequence: Chemically synthesized oligonucleotide
gtgggtgggtaggatgaac

SEQ ID NO: 4923 - DNA, 19 bp, Artificial Sequence
  Description of Artificial Sequence: Chemically synthesized oligonucleotide
ttcatcctacccacccact

SEQ ID NO: 4924 - DNA, 19 bp, Artificial Sequence
  Description of Artificial Sequence: Chemically synthesized oligonucleotide
agtgggtgggtaggatgaa

SEQ ID NO: 4925 - DNA, 19 bp, Artificial Sequence
  Description of Artificial Sequence: Chemically synthesized oligonucleotide
tcatcctacccacccacta

SEQ ID NO: 4926 - DNA, 19 bp, Artificial Sequence
  Description of Artificial Sequence: Chemically synthesized oligonucleotide
tagtgggtgggtaggatga

SEQ ID NO: 4927 - DNA, 19 bp, Artificial Sequence
  Description of Artificial Sequence: Chemically synthesized oligonucleotide
catcctacccacccactaa

SEQ ID NO: 4928 - DNA, 19 bp, Artificial Sequence
  Description of Artificial Sequence: Chemically synthesized oligonucleotide
ttagtgggtgggtaggatg

SEQ ID NO: 4929 - DNA, 19 bp, Artificial Sequence
  Description of Artificial Sequence: Chemically synthesized oligonucleotide
atcctacccacccactaaa

SEQ ID NO: 4930 - DNA, 19 bp, Artificial Sequence
  Description of Artificial Sequence: Chemically synthesized oligonucleotide
tttagtgggtgggtaggat

SEQ ID NO: 4931 - DNA, 19 bp, Artificial Sequence
  Description of Artificial Sequence: Chemically synthesized oligonucleotide
tcctacccacccactaaag

SEQ ID NO: 4932 - DNA, 19 bp, Artificial Sequence
  Description of Artificial Sequence: Chemically synthesized oligonucleotide
ctttagtgggtgggtagga

SEQ ID NO: 4933 - DNA, 19 bp, Artificial Sequence
  Description of Artificial Sequence: Chemically synthesized oligonucleotide
cctacccacccactaaagg

SEQ ID NO: 4934 - DNA, 19 bp, Artificial Sequence
  Description of Artificial Sequence: Chemically synthesized oligonucleotide
cctttagtgggtgggtagg

SEQ ID NO: 4935 - DNA, 19 bp, Artificial Sequence
  Description of Artificial Sequence: Chemically synthesized oligonucleotide
ctacccacccactaaaggt

SEQ ID NO: 4936 - DNA, 19 bp, Artificial Sequence
  Description of Artificial Sequence: Chemically synthesized oligonucleotide
acctttagtgggtgggtag

SEQ ID NO: 4937 - DNA, 19 bp, Artificial Sequence
  Description of Artificial Sequence: Chemically synthesized oligonucleotide
tacccacccactaaaggtg

SEQ ID NO: 4938 - DNA, 19 bp, Artificial Sequence
  Description of Artificial Sequence: Chemically synthesized oligonucleotide
cacctttagtgggtgggta

SEQ ID NO: 4939 - DNA, 19 bp, Artificial Sequence
  Description of Artificial Sequence: Chemically synthesized oligonucleotide
acccacccactaaaggtgg

SEQ ID NO: 4940 - DNA, 19 bp, Artificial Sequence
  Description of Artificial Sequence: Chemically synthesized oligonucleotide
ccacctttagtgggtgggt

SEQ ID NO: 4941 - DNA, 19 bp, Artificial Sequence
  Description of Artificial Sequence: Chemically synthesized oligonucleotide
cccacccactaaaggtggg

SEQ ID NO: 4942 - DNA, 19 bp, Artificial Sequence
  Description of Artificial Sequence: Chemically synthesized oligonucleotide
cccacctttagtgggtggg

SEQ ID NO: 4943 - DNA, 19 bp, Artificial Sequence
  Description of Artificial Sequence: Chemically synthesized oligonucleotide
ccacccactaaaggtgggg

SEQ ID NO: 4944 - DNA, 19 bp, Artificial Sequence
  Description of Artificial Sequence: Chemically synthesized oligonucleotide
ccccacctttagtgggtgg

SEQ ID NO: 4945 - DNA, 19 bp, Artificial Sequence
  Description of Artificial Sequence: Chemically synthesized oligonucleotide
cacccactaaaggtggggg

SEQ ID NO: 4946 - DNA, 19 bp, Artificial Sequence
  Description of Artificial Sequence: Chemically synthesized oligonucleotide
cccccacctttagtgggtg

SEQ ID NO: 4947 - DNA, 19 bp, Artificial Sequence
  Description of Artificial Sequence: Chemically synthesized oligonucleotide
acccactaaaggtgggggt

SEQ ID NO: 4948 - DNA, 19 bp, Artificial Sequence
  Description of Artificial Sequence: Chemically synthesized oligonucleotide
acccccacctttagtgggt

SEQ ID NO: 4949 - DNA, 19 bp, Artificial Sequence
  Description of Artificial Sequence: Chemically synthesized oligonucleotide
cccactaaaggtgggggtc

SEQ ID NO: 4950 - DNA, 19 bp, Artificial Sequence
  Description of Artificial Sequence: Chemically synthesized oligonucleotide
gacccccacctttagtggg

SEQ ID NO: 4951 - DNA, 19 bp, Artificial Sequence
  Description of Artificial Sequence: Chemically synthesized oligonucleotide
ccactaaaggtgggggtct

SEQ ID NO: 4952 - DNA, 19 bp, Artificial Sequence
  Description of Artificial Sequence: Chemically synthesized oligonucleotide
agacccccacctttagtgg

SEQ ID NO: 4953 - DNA, 19 bp, Artificial Sequence
  Description of Artificial Sequence: Chemically synthesized oligonucleotide
cactaaaggtgggggtctt

SEQ ID NO: 4954 - DNA, 19 bp, Artificial Sequence
  Description of Artificial Sequence: Chemically synthesized oligonucleotide
aagacccccacctttagtg

SEQ ID NO: 4955 - DNA, 19 bp, Artificial Sequence
  Description of Artificial Sequence: Chemically synthesized oligonucleotide
actaaaggtgggggtcttg

SEQ ID NO: 4956 - DNA, 19 bp, Artificial Sequence
  Description of Artificial Sequence: Chemically synthesized oligonucleotide
caagacccccacctttagt

SEQ ID NO: 4957 - DNA, 19 bp, Artificial Sequence
  Description of Artificial Sequence: Chemically synthesized oligonucleotide
ctaaaggtgggggtcttgg

SEQ ID NO: 4958 - DNA, 19 bp, Artificial Sequence
  Description of Artificial Sequence: Chemically synthesized oligonucleotide
ccaagacccccacctttag

SEQ ID NO: 4959 - DNA, 19 bp, Artificial Sequence
  Description of Artificial Sequence: Chemically synthesized oligonucleotide
taaaggtgggggtcttggc

SEQ ID NO: 4960 - DNA, 19 bp, Artificial Sequence
  Description of Artificial Sequence: Chemically synthesized oligonucleotide
gccaagacccccaccttta

SEQ ID NO: 4961 - DNA, 19 bp, Artificial Sequence
  Description of Artificial Sequence: Chemically synthesized oligonucleotide
aaaggtgggggtcttggcc

SEQ ID NO: 4962 - DNA, 19 bp, Artificial Sequence
  Description of Artificial Sequence: Chemically synthesized oligonucleotide
ggccaagacccccaccttt

SEQ ID NO: 4963 - DNA, 19 bp, Artificial Sequence
  Description of Artificial Sequence: Chemically synthesized oligonucleotide
aaggtgggggtcttggccc

SEQ ID NO: 4964 - DNA, 19 bp, Artificial Sequence
  Description of Artificial Sequence: Chemically synthesized oligonucleotide
gggccaagacccccacctt

SEQ ID NO: 4965 - DNA, 19 bp, Artificial Sequence
  Description of Artificial Sequence: Chemically synthesized oligonucleotide
aggtgggggtcttggccct

SEQ ID NO: 4966 - DNA, 19 bp, Artificial Sequence
  Description of Artificial Sequence: Chemically synthesized oligonucleotide
agggccaagacccccacct

SEQ ID NO: 4967 - DNA, 19 bp, Artificial Sequence
  Description of Artificial Sequence: Chemically synthesized oligonucleotide
ggtgggggtcttggccctt

SEQ ID NO: 4968 - DNA, 19 bp, Artificial Sequence
  Description of Artificial Sequence: Chemically synthesized oligonucleotide
aagggccaagacccccacc

SEQ ID NO: 4969 - DNA, 19 bp, Artificial Sequence
  Description of Artificial Sequence: Chemically synthesized oligonucleotide
gtgggggtcttggcccttg

SEQ ID NO: 4970 - DNA, 19 bp, Artificial Sequence
  Description of Artificial Sequence: Chemically synthesized oligonucleotide
caagggccaagacccccac

SEQ ID NO: 4971 - DNA, 19 bp, Artificial Sequence
  Description of Artificial Sequence: Chemically synthesized oligonucleotide
tgggggtcttggcccttgt

SEQ ID NO: 4972 - DNA, 19 bp, Artificial Sequence
  Description of Artificial Sequence: Chemically synthesized oligonucleotide
acaagggccaagaccccca

SEQ ID NO: 4973 - DNA, 19 bp, Artificial Sequence
  Description of Artificial Sequence: Chemically synthesized oligonucleotide
gggggtcttggcccttgtg

SEQ ID NO: 4974 - DNA, 19 bp, Artificial Sequence
  Description of Artificial Sequence: Chemically synthesized oligonucleotide
cacaagggccaagaccccc

SEQ ID NO: 4975 - DNA, 19 bp, Artificial Sequence
  Description of Artificial Sequence: Chemically synthesized oligonucleotide
ggggtcttggcccttgtgg

SEQ ID NO: 4976 - DNA, 19 bp, Artificial Sequence
  Description of Artificial Sequence: Chemically synthesized oligonucleotide
ccacaagggccaagacccc

SEQ ID NO: 4977 - DNA, 19 bp, Artificial Sequence
  Description of Artificial Sequence: Chemically synthesized oligonucleotide
gggtcttggcccttgtggg

SEQ ID NO: 4978 - DNA, 19 bp, Artificial Sequence
  Description of Artificial Sequence: Chemically synthesized oligonucleotide
cccacaagggccaagaccc

SEQ ID NO: 4979 - DNA, 19 bp, Artificial Sequence
  Description of Artificial Sequence: Chemically synthesized oligonucleotide
ggtcttggcccttgtggga

SEQ ID NO: 4980 - DNA, 19 bp, Artificial Sequence
  Description of Artificial Sequence: Chemically synthesized oligonucleotide
tcccacaagggccaagacc

SEQ ID NO: 4981 - DNA, 19 bp, Artificial Sequence
  Description of Artificial Sequence: Chemically synthesized oligonucleotide
gtcttggcccttgtgggaa

SEQ ID NO: 4982 - DNA, 19 bp, Artificial Sequence
  Description of Artificial Sequence: Chemically synthesized oligonucleotide
ttcccacaagggccaagac

SEQ ID NO: 4983 - DNA, 19 bp, Artificial Sequence
  Description of Artificial Sequence: Chemically synthesized oligonucleotide
tcttggcccttgtgggaag

SEQ ID NO: 4984 - DNA, 19 bp, Artificial Sequence
  Description of Artificial Sequence: Chemically synthesized oligonucleotide
cttcccacaagggccaaga

SEQ ID NO: 4985 - DNA, 19 bp, Artificial Sequence
  Description of Artificial Sequence: Chemically synthesized oligonucleotide
cttggcccttgtgggaagt

SEQ ID NO: 4986 - DNA, 19 bp, Artificial Sequence
  Description of Artificial Sequence: Chemically synthesized oligonucleotide
acttcccacaagggccaag

SEQ ID NO: 4987 - DNA, 19 bp, Artificial Sequence
  Description of Artificial Sequence: Chemically synthesized oligonucleotide
ttggcccttgtgggaagtg

SEQ ID NO: 4988 - DNA, 19 bp, Artificial Sequence
  Description of Artificial Sequence: Chemically synthesized oligonucleotide
cacttcccacaagggccaa

SEQ ID NO: 4989 - DNA, 19 bp, Artificial Sequence
  Description of Artificial Sequence: Chemically synthesized oligonucleotide
tggcccttgtgggaagtgc

SEQ ID NO: 4990 - DNA, 19 bp, Artificial Sequence
  Description of Artificial Sequence: Chemically synthesized oligonucleotide
gcacttcccacaagggcca

SEQ ID NO: 4991 - DNA, 19 bp, Artificial Sequence
  Description of Artificial Sequence: Chemically synthesized oligonucleotide
ggcccttgtgggaagtgcc

SEQ ID NO: 4992 - DNA, 19 bp, Artificial Sequence
  Description of Artificial Sequence: Chemically synthesized oligonucleotide
ggcacttcccacaagggcc

SEQ ID NO: 4993 - DNA, 19 bp, Artificial Sequence
  Description of Artificial Sequence: Chemically synthesized oligonucleotide
gcccttgtgggaagtgcca

SEQ ID NO: 4994 - DNA, 19 bp, Artificial Sequence
  Description of Artificial Sequence: Chemically synthesized oligonucleotide
tggcacttcccacaagggc

SEQ ID NO: 4995 - DNA, 19 bp, Artificial Sequence
  Description of Artificial Sequence: Chemically synthesized oligonucleotide
cccttgtgggaagtgccag

SEQ ID NO: 4996 - DNA, 19 bp, Artificial Sequence
  Description of Artificial Sequence: Chemically synthesized oligonucleotide
ctggcacttcccacaaggg

SEQ ID NO: 4997 - DNA, 19 bp, Artificial Sequence
  Description of Artificial Sequence: Chemically synthesized oligonucleotide
ccttgtgggaagtgccagg

SEQ ID NO: 4998 - DNA, 19 bp, Artificial Sequence
  Description of Artificial Sequence: Chemically synthesized oligonucleotide
cctggcacttcccacaagg

SEQ ID NO: 4999 - DNA, 19 bp, Artificial Sequence
  Description of Artificial Sequence: Chemically synthesized oligonucleotide
cttgtgggaagtgccagga

SEQ ID NO: 5000 - DNA, 19 bp, Artificial Sequence
  Description of Artificial Sequence: Chemically synthesized oligonucleotide
tcctggcacttcccacaag

SEQ ID NO: 5001 - DNA, 19 bp, Artificial Sequence
  Description of Artificial Sequence: Chemically synthesized oligonucleotide
ttgtgggaagtgccaggag

SEQ ID NO: 5002 - DNA, 19 bp, Artificial Sequence
  Description of Artificial Sequence: Chemically synthesized oligonucleotide
ctcctggcacttcccacaa

SEQ ID NO: 5003 - DNA, 19 bp, Artificial Sequence
  Description of Artificial Sequence: Chemically synthesized oligonucleotide
tgtgggaagtgccaggagg

SEQ ID NO: 5004 - DNA, 19 bp, Artificial Sequence
  Description of Artificial Sequence: Chemically synthesized oligonucleotide
cctcctggcacttcccaca

SEQ ID NO: 5005 - DNA, 19 bp, Artificial Sequence
  Description of Artificial Sequence: Chemically synthesized oligonucleotide
gtgggaagtgccaggaggg

SEQ ID NO: 5006 - DNA, 19 bp, Artificial Sequence
  Description of Artificial Sequence: Chemically synthesized oligonucleotide
ccctcctggcacttcccac

SEQ ID NO: 5007 - DNA, 19 bp, Artificial Sequence
  Description of Artificial Sequence: Chemically synthesized oligonucleotide
tgggaagtgccaggagggc

SEQ ID NO: 5008 - DNA, 19 bp, Artificial Sequence
  Description of Artificial Sequence: Chemically synthesized oligonucleotide
gccctcctggcacttccca

SEQ ID NO: 5009 - DNA, 19 bp, Artificial Sequence
  Description of Artificial Sequence: Chemically synthesized oligonucleotide
gggaagtgccaggagggcc

SEQ ID NO: 5010 - DNA, 19 bp, Artificial Sequence
  Description of Artificial Sequence: Chemically synthesized oligonucleotide
ggccctcctggcacttccc

SEQ ID NO: 5011 - DNA, 19 bp, Artificial Sequence
  Description of Artificial Sequence: Chemically synthesized oligonucleotide
ggaagtgccaggagggcct

SEQ ID NO: 5012 - DNA, 19 bp, Artificial Sequence
  Description of Artificial Sequence: Chemically synthesized oligonucleotide
aggccctcctggcacttcc

SEQ ID NO: 5013 - DNA, 19 bp, Artificial Sequence
  Description of Artificial Sequence: Chemically synthesized oligonucleotide
gaagtgccaggagggcctg

SEQ ID NO: 5014 - DNA, 19 bp, Artificial Sequence
  Description of Artificial Sequence: Chemically synthesized oligonucleotide
caggccctcctggcacttc

SEQ ID NO: 5015 - DNA, 19 bp, Artificial Sequence
  Description of Artificial Sequence: Chemically synthesized oligonucleotide
aagtgccaggagggcctgg

SEQ ID NO: 5016 - DNA, 19 bp, Artificial Sequence
  Description of Artificial Sequence: Chemically synthesized oligonucleotide
ccaggccctcctggcactt

SEQ ID NO: 5017 - DNA, 19 bp, Artificial Sequence
  Description of Artificial Sequence: Chemically synthesized oligonucleotide
agtgccaggagggcctgga

SEQ ID NO: 5018 - DNA, 19 bp, Artificial Sequence
  Description of Artificial Sequence: Chemically synthesized oligonucleotide
tccaggccctcctggcact

SEQ ID NO: 5019 - DNA, 19 bp, Artificial Sequence
  Description of Artificial Sequence: Chemically synthesized oligonucleotide
gtgccaggagggcctggag

SEQ ID NO: 5020 - DNA, 19 bp, Artificial Sequence
  Description of Artificial Sequence: Chemically synthesized oligonucleotide
ctccaggccctcctggcac

SEQ ID NO: 5021 - DNA, 19 bp, Artificial Sequence
  Description of Artificial Sequence: Chemically synthesized oligonucleotide
tgccaggagggcctggagg

SEQ ID NO: 5022 - DNA, 19 bp, Artificial Sequence
  Description of Artificial Sequence: Chemically synthesized oligonucleotide
cctccaggccctcctggca

SEQ ID NO: 5023 - DNA, 19 bp, Artificial Sequence
  Description of Artificial Sequence: Chemically synthesized oligonucleotide
gccaggagggcctggaggg

SEQ ID NO: 5024 - DNA, 19 bp, Artificial Sequence
  Description of Artificial Sequence: Chemically synthesized oligonucleotide
ccctccaggccctcctggc

SEQ ID NO: 5025 - DNA, 19 bp, Artificial Sequence
  Description of Artificial Sequence: Chemically synthesized oligonucleotide
ccaggagggcctggagggg

SEQ ID NO: 5026 - DNA, 19 bp, Artificial Sequence
  Description of Artificial Sequence: Chemically synthesized oligonucleotide
cccctccaggccctcctgg

SEQ ID NO: 5027 - DNA, 19 bp, Artificial Sequence
  Description of Artificial Sequence: Chemically synthesized oligonucleotide
caggagggcctggaggggg

SEQ ID NO: 5028 - DNA, 19 bp, Artificial Sequence
  Description of Artificial Sequence: Chemically synthesized oligonucleotide
ccccctccaggccctcctg

SEQ ID NO: 5029 - DNA, 19 bp, Artificial Sequence
  Description of Artificial Sequence: Chemically synthesized oligonucleotide
aggagggcctggagggggg

SEQ ID NO: 5030 - DNA, 19 bp, Artificial Sequence
  Description of Artificial Sequence: Chemically synthesized oligonucleotide
cccccctccaggccctcct

SEQ ID NO: 5031 - DNA, 19 bp, Artificial Sequence
  Description of Artificial Sequence: Chemically synthesized oligonucleotide
ggagggcctggaggggggt

SEQ ID NO: 5032 - DNA, 19 bp, Artificial Sequence
  Description of Artificial Sequence: Chemically synthesized oligonucleotide
acccccctccaggccctcc

SEQ ID NO: 5033 - DNA, 19 bp, Artificial Sequence
  Description of Artificial Sequence: Chemically synthesized oligonucleotide
gagggcctggaggggggtg

SEQ ID NO: 5034 - DNA, 19 bp, Artificial Sequence
  Description of Artificial Sequence: Chemically synthesized oligonucleotide
cacccccctccaggccctc

SEQ ID NO: 5035 - DNA, 19 bp, Artificial Sequence
  Description of Artificial Sequence: Chemically synthesized oligonucleotide
agggcctggaggggggtgc

SEQ ID NO: 5036 - DNA, 19 bp, Artificial Sequence
  Description of Artificial Sequence: Chemically synthesized oligonucleotide
gcacccccctccaggccct

SEQ ID NO: 5037 - DNA, 19 bp, Artificial Sequence
  Description of Artificial Sequence: Chemically synthesized oligonucleotide
gggcctggaggggggtgcc

SEQ ID NO: 5038 - DNA, 19 bp, Artificial Sequence
  Description of Artificial Sequence: Chemically synthesized oligonucleotide
ggcacccccctccaggccc

SEQ ID NO: 5039 - DNA, 19 bp, Artificial Sequence
  Description of Artificial Sequence: Chemically synthesized oligonucleotide
ggcctggaggggggtgcca

SEQ ID NO: 5040 - DNA, 19 bp, Artificial Sequence
  Description of Artificial Sequence: Chemically synthesized oligonucleotide
tggcacccccctccaggcc

SEQ ID NO: 5041 - DNA, 19 bp, Artificial Sequence
  Description of Artificial Sequence: Chemically synthesized oligonucleotide
gcctggaggggggtgccag

SEQ ID NO: 5042 - DNA, 19 bp, Artificial Sequence
  Description of Artificial Sequence: Chemically synthesized oligonucleotide
ctggcacccccctccaggc

SEQ ID NO: 5043 - DNA, 19 bp, Artificial Sequence
  Description of Artificial Sequence: Chemically synthesized oligonucleotide
cctggaggggggtgccagt

SEQ ID NO: 5044 - DNA, 19 bp, Artificial Sequence
  Description of Artificial Sequence: Chemically synthesized oligonucleotide
actggcacccccctccagg

SEQ ID NO: 5045 - DNA, 19 bp, Artificial Sequence
  Description of Artificial Sequence: Chemically synthesized oligonucleotide
ctggaggggggtgccagtg

SEQ ID NO: 5046 - DNA, 19 bp, Artificial Sequence
  Description of Artificial Sequence: Chemically synthesized oligonucleotide
cactggcacccccctccag

SEQ ID NO: 5047 - DNA, 19 bp, Artificial Sequence
  Description of Artificial Sequence: Chemically synthesized oligonucleotide
tggaggggggtgccagtgg

SEQ ID NO: 5048 - DNA, 19 bp, Artificial Sequence
  Description of Artificial Sequence: Chemically synthesized oligonucleotide
ccactggcacccccctcca

SEQ ID NO: 5049 - DNA, 19 bp, Artificial Sequence
  Description of Artificial Sequence: Chemically synthesized oligonucleotide
ggaggggggtgccagtgga

SEQ ID NO: 5050 - DNA, 19 bp, Artificial Sequence
  Description of Artificial Sequence: Chemically synthesized oligonucleotide
tccactggcacccccctcc

SEQ ID NO: 5051 - DNA, 19 bp, Artificial Sequence
  Description of Artificial Sequence: Chemically synthesized oligonucleotide
gaggggggtgccagtggag

SEQ ID NO: 5052 - DNA, 19 bp, Artificial Sequence
  Description of Artificial Sequence: Chemically synthesized oligonucleotide
ctccactggcacccccctc

SEQ ID NO: 5053 - DNA, 19 bp, Artificial Sequence
  Description of Artificial Sequence: Chemically synthesized oligonucleotide
aggggggtgccagtggagc

SEQ ID NO: 5054 - DNA, 19 bp, Artificial Sequence
  Description of Artificial Sequence: Chemically synthesized oligonucleotide
gctccactggcacccccct

SEQ ID NO: 5055 - DNA, 19 bp, Artificial Sequence
  Description of Artificial Sequence: Chemically synthesized oligonucleotide
ggggggtgccagtggagcc

SEQ ID NO: 5056 - DNA, 19 bp, Artificial Sequence
  Description of Artificial Sequence: Chemically synthesized oligonucleotide
ggctccactggcacccccc

SEQ ID NO: 5057 - DNA, 19 bp, Artificial Sequence
  Description of Artificial Sequence: Chemically synthesized oligonucleotide
gggggtgccagtggagcca

SEQ ID NO: 5058 - DNA, 19 bp, Artificial Sequence
  Description of Artificial Sequence: Chemically synthesized oligonucleotide
tggctccactggcaccccc

SEQ ID NO: 5059 - DNA, 19 bp, Artificial Sequence
  Description of Artificial Sequence: Chemically synthesized oligonucleotide
ggggtgccagtggagccag

SEQ ID NO: 5060 - DNA, 19 bp, Artificial Sequence
  Description of Artificial Sequence: Chemically synthesized oligonucleotide
ctggctccactggcacccc

SEQ ID NO: 5061 - DNA, 19 bp, Artificial Sequence
  Description of Artificial Sequence: Chemically synthesized oligonucleotide
gggtgccagtggagccagc

SEQ ID NO: 5062 - DNA, 19 bp, Artificial Sequence
  Description of Artificial Sequence: Chemically synthesized oligonucleotide
gctggctccactggcaccc

SEQ ID NO: 5063 - DNA, 19 bp, Artificial Sequence
  Description of Artificial Sequence: Chemically synthesized oligonucleotide
ggtgccagtggagccagcg

SEQ ID NO: 5064 - DNA, 19 bp, Artificial Sequence
  Description of Artificial Sequence: Chemically synthesized oligonucleotide
cgctggctccactggcacc

SEQ ID NO: 5065 - DNA, 19 bp, Artificial Sequence
  Description of Artificial Sequence: Chemically synthesized oligonucleotide
gtgccagtggagccagcga

SEQ ID NO: 5066 - DNA, 19 bp, Artificial Sequence
  Description of Artificial Sequence: Chemically synthesized oligonucleotide
tcgctggctccactggcac

SEQ ID NO: 5067 - DNA, 19 bp, Artificial Sequence
  Description of Artificial Sequence: Chemically synthesized oligonucleotide
tgccagtggagccagcgaa

SEQ ID NO: 5068 - DNA, 19 bp, Artificial Sequence
  Description of Artificial Sequence: Chemically synthesized oligonucleotide
ttcgctggctccactggca

SEQ ID NO: 5069 - DNA, 19 bp, Artificial Sequence
  Description of Artificial Sequence: Chemically synthesized oligonucleotide
gccagtggagccagcgaac

SEQ ID NO: 5070 - DNA, 19 bp, Artificial Sequence
  Description of Artificial Sequence: Chemically synthesized oligonucleotide
gttcgctggctccactggc

SEQ ID NO: 5071 - DNA, 19 bp, Artificial Sequence
  Description of Artificial Sequence: Chemically synthesized oligonucleotide
ccagtggagccagcgaacc

SEQ ID NO: 5072 - DNA, 19 bp, Artificial Sequence
  Description of Artificial Sequence: Chemically synthesized oligonucleotide
ggttcgctggctccactgg

SEQ ID NO: 5073 - DNA, 19 bp, Artificial Sequence
  Description of Artificial Sequence: Chemically synthesized oligonucleotide
cagtggagccagcgaaccc

SEQ ID NO: 5074 - DNA, 19 bp, Artificial Sequence
  Description of Artificial Sequence: Chemically synthesized oligonucleotide
gggttcgctggctccactg

SEQ ID NO: 5075 - DNA, 19 bp, Artificial Sequence
  Description of Artificial Sequence: Chemically synthesized oligonucleotide
agtggagccagcgaaccca

SEQ ID NO: 5076 - DNA, 19 bp, Artificial Sequence
  Description of Artificial Sequence: Chemically synthesized oligonucleotide
tgggttcgctggctccact

SEQ ID NO: 5077 - DNA, 19 bp, Artificial Sequence
  Description of Artificial Sequence: Chemically synthesized oligonucleotide
gtggagccagcgaacccag

SEQ ID NO: 5078 - DNA, 19 bp, Artificial Sequence
  Description of Artificial Sequence: Chemically synthesized oligonucleotide
ctgggttcgctggctccac

SEQ ID NO: 5079 - DNA, 19 bp, Artificial Sequence
  Description of Artificial Sequence: Chemically synthesized oligonucleotide
tggagccagcgaacccagc

SEQ ID NO: 5080 - DNA, 19 bp, Artificial Sequence
  Description of Artificial Sequence: Chemically synthesized oligonucleotide
gctgggttcgctggctcca

SEQ ID NO: 5081 - DNA, 19 bp, Artificial Sequence
  Description of Artificial Sequence: Chemically synthesized oligonucleotide
ggagccagcgaacccagcg

SEQ ID NO: 5082 - DNA, 19 bp, Artificial Sequence
  Description of Artificial Sequence: Chemically synthesized oligonucleotide
cgctgggttcgctggctcc

SEQ ID NO: 5083 - DNA, 19 bp, Artificial Sequence
  Description of Artificial Sequence: Chemically synthesized oligonucleotide
gagccagcgaacccagcga

SEQ ID NO: 5084 - DNA, 19 bp, Artificial Sequence
  Description of Artificial Sequence: Chemically synthesized oligonucleotide
tcgctgggttcgctggctc

SEQ ID NO: 5085 - DNA, 19 bp, Artificial Sequence
  Description of Artificial Sequence: Chemically synthesized oligonucleotide
agccagcgaacccagcgag

SEQ ID NO: 5086 - DNA, 19 bp, Artificial Sequence
  Description of Artificial Sequence: Chemically synthesized oligonucleotide
ctcgctgggttcgctggct

SEQ ID NO: 5087 - DNA, 19 bp, Artificial Sequence
  Description of Artificial Sequence: Chemically synthesized oligonucleotide
gccagcgaacccagcgagg

SEQ ID NO: 5088 - DNA, 19 bp, Artificial Sequence
  Description of Artificial Sequence: Chemically synthesized oligonucleotide
cctcgctgggttcgctggc

SEQ ID NO: 5089 - DNA, 19 bp, Artificial Sequence
  Description of Artificial Sequence: Chemically synthesized oligonucleotide
ccagcgaacccagcgagga

SEQ ID NO: 5090 - DNA, 19 bp, Artificial Sequence
  Description of Artificial Sequence: Chemically synthesized oligonucleotide
tcctcgctgggttcgctgg

SEQ ID NO: 5091 - DNA, 19 bp, Artificial Sequence
  Description of Artificial Sequence: Chemically synthesized oligonucleotide
cagcgaacccagcgaggaa

SEQ ID NO: 5092 - DNA, 19 bp, Artificial Sequence
  Description of Artificial Sequence: Chemically synthesized oligonucleotide
ttcctcgctgggttcgctg

SEQ ID NO: 5093 - DNA, 19 bp, Artificial Sequence
  Description of Artificial Sequence: Chemically synthesized oligonucleotide
agcgaacccagcgaggaag

SEQ ID NO: 5094 - DNA, 19 bp, Artificial Sequence
  Description of Artificial Sequence: Chemically synthesized oligonucleotide
cttcctcgctgggttcgct

SEQ ID NO: 5095 - DNA, 19 bp, Artificial Sequence
  Description of Artificial Sequence: Chemically synthesized oligonucleotide
gcgaacccagcgaggaagt

SEQ ID NO: 5096 - DNA, 19 bp, Artificial Sequence
  Description of Artificial Sequence: Chemically synthesized oligonucleotide
acttcctcgctgggttcgc

SEQ ID NO: 5097 - DNA, 19 bp, Artificial Sequence
  Description of Artificial Sequence: Chemically synthesized oligonucleotide
cgaacccagcgaggaagtg

SEQ ID NO: 5098 - DNA, 19 bp, Artificial Sequence
  Description of Artificial Sequence: Chemically synthesized oligonucleotide
cacttcctcgctgggttcg

SEQ ID NO: 5099 - DNA, 19 bp, Artificial Sequence
  Description of Artificial Sequence: Chemically synthesized oligonucleotide
gaacccagcgaggaagtga

SEQ ID NO: 5100 - DNA, 19 bp, Artificial Sequence
  Description of Artificial Sequence: Chemically synthesized oligonucleotide
tcacttcctcgctgggttc

SEQ ID NO: 5101 - DNA, 19 bp, Artificial Sequence
  Description of Artificial Sequence: Chemically synthesized oligonucleotide
aacccagcgaggaagtgaa

SEQ ID NO: 5102 - DNA, 19 bp, Artificial Sequence
  Description of Artificial Sequence: Chemically synthesized oligonucleotide
ttcacttcctcgctgggtt

SEQ ID NO: 5103 - DNA, 19 bp, Artificial Sequence
  Description of Artificial Sequence: Chemically synthesized oligonucleotide
acccagcgaggaagtgaac

SEQ ID NO: 5104 - DNA, 19 bp, Artificial Sequence
  Description of Artificial Sequence: Chemically synthesized oligonucleotide
gttcacttcctcgctgggt

SEQ ID NO: 5105 - DNA, 19 bp, Artificial Sequence
  Description of Artificial Sequence: Chemically synthesized oligonucleotide
cccagcgaggaagtgaaca

SEQ ID NO: 5106 - DNA, 19 bp, Artificial Sequence
  Description of Artificial Sequence: Chemically synthesized oligonucleotide
tgttcacttcctcgctggg

SEQ ID NO: 5107 - DNA, 19 bp, Artificial Sequence
  Description of Artificial Sequence: Chemically synthesized oligonucleotide
ccagcgaggaagtgaacaa

SEQ ID NO: 5108 - DNA, 19 bp, Artificial Sequence
  Description of Artificial Sequence: Chemically synthesized oligonucleotide
ttgttcacttcctcgctgg

SEQ ID NO: 5109 - DNA, 19 bp, Artificial Sequence
  Description of Artificial Sequence: Chemically synthesized oligonucleotide
cagcgaggaagtgaacaag

SEQ ID NO: 5110 - DNA, 19 bp, Artificial Sequence
  Description of Artificial Sequence: Chemically synthesized oligonucleotide
cttgttcacttcctcgctg

SEQ ID NO: 5111 - DNA, 19 bp, Artificial Sequence
  Description of Artificial Sequence: Chemically synthesized oligonucleotide
agcgaggaagtgaacaagg

SEQ ID NO: 5112 - DNA, 19 bp, Artificial Sequence
  Description of Artificial Sequence: Chemically synthesized oligonucleotide
ccttgttcacttcctcgct

SEQ ID NO: 5113 - DNA, 19 bp, Artificial Sequence
  Description of Artificial Sequence: Chemically synthesized oligonucleotide
gcgaggaagtgaacaaggc

SEQ ID NO: 5114 - DNA, 19 bp, Artificial Sequence
  Description of Artificial Sequence: Chemically synthesized oligonucleotide
gccttgttcacttcctcgc

SEQ ID NO: 5115 - DNA, 19 bp, Artificial Sequence
  Description of Artificial Sequence: Chemically synthesized oligonucleotide
cgaggaagtgaacaaggcc

SEQ ID NO: 5116 - DNA, 19 bp, Artificial Sequence
  Description of Artificial Sequence: Chemically synthesized oligonucleotide
ggccttgttcacttcctcg

SEQ ID NO: 5117 - DNA, 19 bp, Artificial Sequence
  Description of Artificial Sequence: Chemically synthesized oligonucleotide
gaggaagtgaacaaggcct

SEQ ID NO: 5118 - DNA, 19 bp, Artificial Sequence
  Description of Artificial Sequence: Chemically synthesized oligonucleotide
aggccttgttcacttcctc

SEQ ID NO: 5119 - DNA, 19 bp, Artificial Sequence
  Description of Artificial Sequence: Chemically synthesized oligonucleotide
aggaagtgaacaaggcctc

SEQ ID NO: 5120 - DNA, 19 bp, Artificial Sequence
  Description of Artificial Sequence: Chemically synthesized oligonucleotide
gaggccttgttcacttcct

SEQ ID NO: 5121 - DNA, 19 bp, Artificial Sequence
  Description of Artificial Sequence: Chemically synthesized oligonucleotide
ggaagtgaacaaggcctct

SEQ ID NO: 5122 - DNA, 19 bp, Artificial Sequence
  Description of Artificial Sequence: Chemically synthesized oligonucleotide
agaggccttgttcacttcc

SEQ ID NO: 5123 - DNA, 19 bp, Artificial Sequence
  Description of Artificial Sequence: Chemically synthesized oligonucleotide
gaagtgaacaaggcctctg

SEQ ID NO: 5124 - DNA, 19 bp, Artificial Sequence
  Description of Artificial Sequence: Chemically synthesized oligonucleotide
cagaggccttgttcacttc

SEQ ID NO: 5125 - DNA, 19 bp, Artificial Sequence
  Description of Artificial Sequence: Chemically synthesized oligonucleotide
aagtgaacaaggcctctgg

SEQ ID NO: 5126 - DNA, 19 bp, Artificial Sequence
  Description of Artificial Sequence: Chemically synthesized oligonucleotide
ccagaggccttgttcactt

SEQ ID NO: 5127 - DNA, 19 bp, Artificial Sequence
  Description of Artificial Sequence: Chemically synthesized oligonucleotide
agtgaacaaggcctctggc

SEQ ID NO: 5128 - DNA, 19 bp, Artificial Sequence
  Description of Artificial Sequence: Chemically synthesized oligonucleotide
gccagaggccttgttcact

SEQ ID NO: 5129 - DNA, 19 bp, Artificial Sequence
  Description of Artificial Sequence: Chemically synthesized oligonucleotide
gtgaacaaggcctctggcc

SEQ ID NO: 5130 - DNA, 19 bp, Artificial Sequence
  Description of Artificial Sequence: Chemically synthesized oligonucleotide
ggccagaggccttgttcac

SEQ ID NO: 5131 - DNA, 19 bp, Artificial Sequence
  Description of Artificial Sequence: Chemically synthesized oligonucleotide
tgaacaaggcctctggccc

SEQ ID NO: 5132 - DNA, 19 bp, Artificial Sequence
  Description of Artificial Sequence: Chemically synthesized oligonucleotide
gggccagaggccttgttca

SEQ ID NO: 5133 - DNA, 19 bp, Artificial Sequence
  Description of Artificial Sequence: Chemically synthesized oligonucleotide
gaacaaggcctctggcccc

SEQ ID NO: 5134 - DNA, 19 bp, Artificial Sequence
  Description of Artificial Sequence: Chemically synthesized oligonucleotide
ggggccagaggccttgttc

SEQ ID NO: 5135 - DNA, 19 bp, Artificial Sequence
  Description of Artificial Sequence: Chemically synthesized oligonucleotide
aacaaggcctctggcccca

SEQ ID NO: 5136 - DNA, 19 bp, Artificial Sequence
  Description of Artificial Sequence: Chemically synthesized oligonucleotide
tggggccagaggccttgtt

SEQ ID NO: 5137 - DNA, 19 bp, Artificial Sequence
  Description of Artificial Sequence: Chemically synthesized oligonucleotide
acaaggcctctggccccag

SEQ ID NO: 5138 - DNA, 19 bp, Artificial Sequence
  Description of Artificial Sequence: Chemically synthesized oligonucleotide
ctggggccagaggccttgt

SEQ ID NO: 5139 - DNA, 19 bp, Artificial Sequence
  Description of Artificial Sequence: Chemically synthesized oligonucleotide
caaggcctctggccccagg

SEQ ID NO: 5140 - DNA, 19 bp, Artificial Sequence
  Description of Artificial Sequence: Chemically synthesized oligonucleotide
cctggggccagaggccttg

SEQ ID NO: 5141 - DNA, 19 bp, Artificial Sequence
  Description of Artificial Sequence: Chemically synthesized oligonucleotide
aaggcctctggccccaggg

SEQ ID NO: 5142 - DNA, 19 bp, Artificial Sequence
  Description of Artificial Sequence: Chemically synthesized oligonucleotide
ccctggggccagaggcctt

SEQ ID NO: 5143 - DNA, 19 bp, Artificial Sequence
  Description of Artificial Sequence: Chemically synthesized oligonucleotide
aggcctctggccccagggc

SEQ ID NO: 5144 - DNA, 19 bp, Artificial Sequence
  Description of Artificial Sequence: Chemically synthesized oligonucleotide
gccctggggccagaggcct

SEQ ID NO: 5145 - DNA, 19 bp, Artificial Sequence
  Description of Artificial Sequence: Chemically synthesized oligonucleotide
ggcctctggccccagggcc

SEQ ID NO: 5146 - DNA, 19 bp, Artificial Sequence
  Description of Artificial Sequence: Chemically synthesized oligonucleotide
ggccctggggccagaggcc

SEQ ID NO: 5147 - DNA, 19 bp, Artificial Sequence
  Description of Artificial Sequence: Chemically synthesized oligonucleotide
gcctctggccccagggcct

SEQ ID NO: 5148 - DNA, 19 bp, Artificial Sequence
  Description of Artificial Sequence: Chemically synthesized oligonucleotide
aggccctggggccagaggc

SEQ ID NO: 5149 - DNA, 19 bp, Artificial Sequence
  Description of Artificial Sequence: Chemically synthesized oligonucleotide
cctctggccccagggcctg

SEQ ID NO: 5150 - DNA, 19 bp, Artificial Sequence
  Description of Artificial Sequence: Chemically synthesized oligonucleotide
caggccctggggccagagg

SEQ ID NO: 5151 - DNA, 19 bp, Artificial Sequence
  Description of Artificial Sequence: Chemically synthesized oligonucleotide
ctctggccccagggcctgt

SEQ ID NO: 5152 - DNA, 19 bp, Artificial Sequence
  Description of Artificial Sequence: Chemically synthesized oligonucleotide
acaggccctggggccagag

SEQ ID NO: 5153 - DNA, 19 bp, Artificial Sequence
  Description of Artificial Sequence: Chemically synthesized oligonucleotide
tctggccccagggcctgtc

SEQ ID NO: 5154 - DNA, 19 bp, Artificial Sequence
  Description of Artificial Sequence: Chemically synthesized oligonucleotide
gacaggccctggggccaga

SEQ ID NO: 5155 - DNA, 19 bp, Artificial Sequence
  Description of Artificial Sequence: Chemically synthesized oligonucleotide
ctggccccagggcctgtcc

SEQ ID NO: 5156 - DNA, 19 bp, Artificial Sequence
  Description of Artificial Sequence: Chemically synthesized oligonucleotide
ggacaggccctggggccag

SEQ ID NO: 5157 - DNA, 19 bp, Artificial Sequence
  Description of Artificial Sequence: Chemically synthesized oligonucleotide
tggccccagggcctgtccc

SEQ ID NO: 5158 - DNA, 19 bp, Artificial Sequence
  Description of Artificial Sequence: Chemically synthesized oligonucleotide
gggacaggccctggggcca

SEQ ID NO: 5159 - DNA, 19 bp, Artificial Sequence
  Description of Artificial Sequence: Chemically synthesized oligonucleotide
ggccccagggcctgtcccc

SEQ ID NO: 5160 - DNA, 19 bp, Artificial Sequence
  Description of Artificial Sequence: Chemically synthesized oligonucleotide
ggggacaggccctggggcc

SEQ ID NO: 5161 - DNA, 19 bp, Artificial Sequence
  Description of Artificial Sequence: Chemically synthesized oligonucleotide
gccccagggcctgtccccc

SEQ ID NO: 5162 - DNA, 19 bp, Artificial Sequence
  Description of Artificial Sequence: Chemically synthesized oligonucleotide
gggggacaggccctggggc

SEQ ID NO: 5163 - DNA, 19 bp, Artificial Sequence
  Description of Artificial Sequence: Chemically synthesized oligonucleotide
ccccagggcctgtcccccc

SEQ ID NO: 5164 - DNA, 19 bp, Artificial Sequence
  Description of Artificial Sequence: Chemically synthesized oligonucleotide
ggggggacaggccctgggg

SEQ ID NO: 5165 - DNA, 19 bp, Artificial Sequence
  Description of Artificial Sequence: Chemically synthesized oligonucleotide
cccagggcctgtcccccca

SEQ ID NO: 5166 - DNA, 19 bp, Artificial Sequence
  Description of Artificial Sequence: Chemically synthesized oligonucleotide
tggggggacaggccctggg

SEQ ID NO: 5167 - DNA, 19 bp, Artificial Sequence
  Description of Artificial Sequence: Chemically synthesized oligonucleotide
ccagggcctgtccccccag

SEQ ID NO: 5168 - DNA, 19 bp, Artificial Sequence
  Description of Artificial Sequence: Chemically synthesized oligonucleotide
ctggggggacaggccctgg

SEQ ID NO: 5169 - DNA, 19 bp, Artificial Sequence
  Description of Artificial Sequence: Chemically synthesized oligonucleotide
cagggcctgtccccccagc

SEQ ID NO: 5170 - DNA, 19 bp, Artificial Sequence
  Description of Artificial Sequence: Chemically synthesized oligonucleotide
gctggggggacaggccctg

SEQ ID NO: 5171 - DNA, 19 bp, Artificial Sequence
  Description of Artificial Sequence: Chemically synthesized oligonucleotide
agggcctgtccccccagcc

SEQ ID NO: 5172 - DNA, 19 bp, Artificial Sequence
  Description of Artificial Sequence: Chemically synthesized oligonucleotide
ggctggggggacaggccct

SEQ ID NO: 5173 - DNA, 19 bp, Artificial Sequence
  Description of Artificial Sequence: Chemically synthesized oligonucleotide
gggcctgtccccccagcca

SEQ ID NO: 5174 - DNA, 19 bp, Artificial Sequence
  Description of Artificial Sequence: Chemically synthesized oligonucleotide
tggctggggggacaggccc

SEQ ID NO: 5175 - DNA, 19 bp, Artificial Sequence
  Description of Artificial Sequence: Chemically synthesized oligonucleotide
ggcctgtccccccagccac

SEQ ID NO: 5176 - DNA, 19 bp, Artificial Sequence
  Description of Artificial Sequence: Chemically synthesized oligonucleotide
gtggctggggggacaggcc

SEQ ID NO: 5177 - DNA, 19 bp, Artificial Sequence
  Description of Artificial Sequence: Chemically synthesized oligonucleotide
gcctgtccccccagccacc

SEQ ID NO: 5178 - DNA, 19 bp, Artificial Sequence
  Description of Artificial Sequence: Chemically synthesized oligonucleotide
ggtggctggggggacaggc

SEQ ID NO: 5179 - DNA, 19 bp, Artificial Sequence
  Description of Artificial Sequence: Chemically synthesized oligonucleotide
cctgtccccccagccacca

SEQ ID NO: 5180 - DNA, 19 bp, Artificial Sequence
  Description of Artificial Sequence: Chemically synthesized oligonucleotide
tggtggctggggggacagg

SEQ ID NO: 5181 - DNA, 19 bp, Artificial Sequence
  Description of Artificial Sequence: Chemically synthesized oligonucleotide
ctgtccccccagccaccac

SEQ ID NO: 5182 - DNA, 19 bp, Artificial Sequence
  Description of Artificial Sequence: Chemically synthesized oligonucleotide
gtggtggctggggggacag

SEQ ID NO: 5183 - DNA, 19 bp, Artificial Sequence
  Description of Artificial Sequence: Chemically synthesized oligonucleotide
tgtccccccagccaccaca

SEQ ID NO: 5184 - DNA, 19 bp, Artificial Sequence
  Description of Artificial Sequence: Chemically synthesized oligonucleotide
tgtggtggctggggggaca

SEQ ID NO: 5185 - DNA, 19 bp, Artificial Sequence
  Description of Artificial Sequence: Chemically synthesized oligonucleotide
gtccccccagccaccacac

SEQ ID NO: 5186 - DNA, 19 bp, Artificial Sequence
  Description of Artificial Sequence: Chemically synthesized oligonucleotide
gtgtggtggctggggggac

SEQ ID NO: 5187 - DNA, 19 bp, Artificial Sequence
  Description of Artificial Sequence: Chemically synthesized oligonucleotide
tccccccagccaccacacc

SEQ ID NO: 5188 - DNA, 19 bp, Artificial Sequence
  Description of Artificial Sequence: Chemically synthesized oligonucleotide
ggtgtggtggctgggggga

SEQ ID NO: 5189 - DNA, 19 bp, Artificial Sequence
  Description of Artificial Sequence: Chemically synthesized oligonucleotide
ccccccagccaccacacca

SEQ ID NO: 5190 - DNA, 19 bp, Artificial Sequence
  Description of Artificial Sequence: Chemically synthesized oligonucleotide
tggtgtggtggctgggggg

SEQ ID NO: 5191 - DNA, 19 bp, Artificial Sequence
  Description of Artificial Sequence: Chemically synthesized oligonucleotide
cccccagccaccacaccaa

SEQ ID NO: 5192 - DNA, 19 bp, Artificial Sequence
  Description of Artificial Sequence: Chemically synthesized oligonucleotide
ttggtgtggtggctggggg

SEQ ID NO: 5193 - DNA, 19 bp, Artificial Sequence
  Description of Artificial Sequence: Chemically synthesized oligonucleotide
ccccagccaccacaccaag

SEQ ID NO: 5194 - DNA, 19 bp, Artificial Sequence
  Description of Artificial Sequence: Chemically synthesized oligonucleotide
cttggtgtggtggctgggg

SEQ ID NO: 5195 - DNA, 19 bp, Artificial Sequence
  Description of Artificial Sequence: Chemically synthesized oligonucleotide
cccagccaccacaccaagc

SEQ ID NO: 5196 - DNA, 19 bp, Artificial Sequence
  Description of Artificial Sequence: Chemically synthesized oligonucleotide
gcttggtgtggtggctggg

SEQ ID NO: 5197 - DNA, 19 bp, Artificial Sequence
  Description of Artificial Sequence: Chemically synthesized oligonucleotide
ccagccaccacaccaagct

SEQ ID NO: 5198 - DNA, 19 bp, Artificial Sequence
  Description of Artificial Sequence: Chemically synthesized oligonucleotide
agcttggtgtggtggctgg

SEQ ID NO: 5199 - DNA, 19 bp, Artificial Sequence
  Description of Artificial Sequence: Chemically synthesized oligonucleotide
cagccaccacaccaagctg

SEQ ID NO: 5200 - DNA, 19 bp, Artificial Sequence
  Description of Artificial Sequence: Chemically synthesized oligonucleotide
cagcttggtgtggtggctg

SEQ ID NO: 5201 - DNA, 19 bp, Artificial Sequence
  Description of Artificial Sequence: Chemically synthesized oligonucleotide
agccaccacaccaagctga

SEQ ID NO: 5202 - DNA, 19 bp, Artificial Sequence
  Description of Artificial Sequence: Chemically synthesized oligonucleotide
tcagcttggtgtggtggct

SEQ ID NO: 5203 - DNA, 19 bp, Artificial Sequence
  Description of Artificial Sequence: Chemically synthesized oligonucleotide
gccaccacaccaagctgaa

SEQ ID NO: 5204 - DNA, 19 bp, Artificial Sequence
  Description of Artificial Sequence: Chemically synthesized oligonucleotide
ttcagcttggtgtggtggc

SEQ ID NO: 5205 - DNA, 19 bp, Artificial Sequence
  Description of Artificial Sequence: Chemically synthesized oligonucleotide
ccaccacaccaagctgaag

SEQ ID NO: 5206 - DNA, 19 bp, Artificial Sequence
  Description of Artificial Sequence: Chemically synthesized oligonucleotide
cttcagcttggtgtggtgg

SEQ ID NO: 5207 - DNA, 19 bp, Artificial Sequence
  Description of Artificial Sequence: Chemically synthesized oligonucleotide
caccacaccaagctgaaga

SEQ ID NO: 5208 - DNA, 19 bp, Artificial Sequence
  Description of Artificial Sequence: Chemically synthesized oligonucleotide
tcttcagcttggtgtggtg

SEQ ID NO: 5209 - DNA, 19 bp, Artificial Sequence
  Description of Artificial Sequence: Chemically synthesized oligonucleotide
accacaccaagctgaagaa

SEQ ID NO: 5210 - DNA, 19 bp, Artificial Sequence
  Description of Artificial Sequence: Chemically synthesized oligonucleotide
ttcttcagcttggtgtggt

SEQ ID NO: 5211 - DNA, 19 bp, Artificial Sequence
  Description of Artificial Sequence: Chemically synthesized oligonucleotide
ccacaccaagctgaagaag

SEQ ID NO: 5212 - DNA, 19 bp, Artificial Sequence
  Description of Artificial Sequence: Chemically synthesized oligonucleotide
cttcttcagcttggtgtgg

SEQ ID NO: 5213 - DNA, 19 bp, Artificial Sequence
  Description of Artificial Sequence: Chemically synthesized oligonucleotide
cacaccaagctgaagaaga

SEQ ID NO: 5214 - DNA, 19 bp, Artificial Sequence
  Description of Artificial Sequence: Chemically synthesized oligonucleotide
tcttcttcagcttggtgtg

SEQ ID NO: 5215 - DNA, 19 bp, Artificial Sequence
  Description of Artificial Sequence: Chemically synthesized oligonucleotide
acaccaagctgaagaagac

SEQ ID NO: 5216 - DNA, 19 bp, Artificial Sequence
  Description of Artificial Sequence: Chemically synthesized oligonucleotide
gtcttcttcagcttggtgt

SEQ ID NO: 5217 - DNA, 19 bp, Artificial Sequence
  Description of Artificial Sequence: Chemically synthesized oligonucleotide
caccaagctgaagaagaca

SEQ ID NO: 5218 - DNA, 19 bp, Artificial Sequence
  Description of Artificial Sequence: Chemically synthesized oligonucleotide
tgtcttcttcagcttggtg

SEQ ID NO: 5219 - DNA, 19 bp, Artificial Sequence
  Description of Artificial Sequence: Chemically synthesized oligonucleotide
accaagctgaagaagacat

SEQ ID NO: 5220 - DNA, 19 bp, Artificial Sequence
  Description of Artificial Sequence: Chemically synthesized oligonucleotide
atgtcttcttcagcttggt

SEQ ID NO: 5221 - DNA, 19 bp, Artificial Sequence
  Description of Artificial Sequence: Chemically synthesized oligonucleotide
ccaagctgaagaagacatg

SEQ ID NO: 5222 - DNA, 19 bp, Artificial Sequence
  Description of Artificial Sequence: Chemically synthesized oligonucleotide
catgtcttcttcagcttgg

SEQ ID NO: 5223 - DNA, 19 bp, Artificial Sequence
  Description of Artificial Sequence: Chemically synthesized oligonucleotide
caagctgaagaagacatgg

SEQ ID NO: 5224 - DNA, 19 bp, Artificial Sequence
  Description of Artificial Sequence: Chemically synthesized oligonucleotide
ccatgtcttcttcagcttg

SEQ ID NO: 5225 - DNA, 19 bp, Artificial Sequence
  Description of Artificial Sequence: Chemically synthesized oligonucleotide
aagctgaagaagacatggc

SEQ ID NO: 5226 - DNA, 19 bp, Artificial Sequence
  Description of Artificial Sequence: Chemically synthesized oligonucleotide
gccatgtcttcttcagctt

SEQ ID NO: 5227 - DNA, 19 bp, Artificial Sequence
  Description of Artificial Sequence: Chemically synthesized oligonucleotide
agctgaagaagacatggct

SEQ ID NO: 5228 - DNA, 19 bp, Artificial Sequence
  Description of Artificial Sequence: Chemically synthesized oligonucleotide
agccatgtcttcttcagct

SEQ ID NO: 5229 - DNA, 19 bp, Artificial Sequence
  Description of Artificial Sequence: Chemically synthesized oligonucleotide
gctgaagaagacatggctc

SEQ ID NO: 5230 - DNA, 19 bp, Artificial Sequence
  Description of Artificial Sequence: Chemically synthesized oligonucleotide
gagccatgtcttcttcagc

SEQ ID NO: 5231 - DNA, 19 bp, Artificial Sequence
  Description of Artificial Sequence: Chemically synthesized oligonucleotide
ctgaagaagacatggctca

SEQ ID NO: 5232 - DNA, 19 bp, Artificial Sequence
  Description of Artificial Sequence: Chemically synthesized oligonucleotide
tgagccatgtcttcttcag

SEQ ID NO: 5233 - DNA, 19 bp, Artificial Sequence
  Description of Artificial Sequence: Chemically synthesized oligonucleotide
tgaagaagacatggctcac

SEQ ID NO: 5234 - DNA, 19 bp, Artificial Sequence
  Description of Artificial Sequence: Chemically synthesized oligonucleotide
gtgagccatgtcttcttca

SEQ ID NO: 5235 - DNA, 19 bp, Artificial Sequence
  Description of Artificial Sequence: Chemically synthesized oligonucleotide
gaagaagacatggctcaca

SEQ ID NO: 5236 - DNA, 19 bp, Artificial Sequence
  Description of Artificial Sequence: Chemically synthesized oligonucleotide
tgtgagccatgtcttcttc

SEQ ID NO: 5237 - DNA, 19 bp, Artificial Sequence
  Description of Artificial Sequence: Chemically synthesized oligonucleotide
aagaagacatggctcacac

SEQ ID NO: 5238 - DNA, 19 bp, Artificial Sequence
  Description of Artificial Sequence: Chemically synthesized oligonucleotide
gtgtgagccatgtcttctt

SEQ ID NO: 5239 - DNA, 19 bp, Artificial Sequence
  Description of Artificial Sequence: Chemically synthesized oligonucleotide
agaagacatggctcacacg

SEQ ID NO: 5240 - DNA, 19 bp, Artificial Sequence
  Description of Artificial Sequence: Chemically synthesized oligonucleotide
cgtgtgagccatgtcttct

SEQ ID NO: 5241 - DNA, 19 bp, Artificial Sequence
  Description of Artificial Sequence: Chemically synthesized oligonucleotide
gaagacatggctcacacgg

SEQ ID NO: 5242 - DNA, 19 bp, Artificial Sequence
  Description of Artificial Sequence: Chemically synthesized oligonucleotide
ccgtgtgagccatgtcttc

SEQ ID NO: 5243 - DNA, 19 bp, Artificial Sequence
  Description of Artificial Sequence: Chemically synthesized oligonucleotide
aagacatggctcacacggc

SEQ ID NO: 5244 - DNA, 19 bp, Artificial Sequence
  Description of Artificial Sequence: Chemically synthesized oligonucleotide
gccgtgtgagccatgtctt

SEQ ID NO: 5245 - DNA, 19 bp, Artificial Sequence
  Description of Artificial Sequence: Chemically synthesized oligonucleotide
agacatggctcacacggca

SEQ ID NO: 5246 - DNA, 19 bp, Artificial Sequence
  Description of Artificial Sequence: Chemically synthesized oligonucleotide
tgccgtgtgagccatgtct

SEQ ID NO: 5247 - DNA, 19 bp, Artificial Sequence
  Description of Artificial Sequence: Chemically synthesized oligonucleotide
gacatggctcacacggcac

SEQ ID NO: 5248 - DNA, 19 bp, Artificial Sequence
  Description of Artificial Sequence: Chemically synthesized oligonucleotide
gtgccgtgtgagccatgtc

SEQ ID NO: 5249 - DNA, 19 bp, Artificial Sequence
  Description of Artificial Sequence: Chemically synthesized oligonucleotide
acatggctcacacggcact

SEQ ID NO: 5250 - DNA, 19 bp, Artificial Sequence
  Description of Artificial Sequence: Chemically synthesized oligonucleotide
agtgccgtgtgagccatgt

SEQ ID NO: 5251 - DNA, 19 bp, Artificial Sequence
  Description of Artificial Sequence: Chemically synthesized oligonucleotide
catggctcacacggcactc

SEQ ID NO: 5252 - DNA, 19 bp, Artificial Sequence
  Description of Artificial Sequence: Chemically synthesized oligonucleotide
gagtgccgtgtgagccatg

SEQ ID NO: 5253 - DNA, 19 bp, Artificial Sequence
  Description of Artificial Sequence: Chemically synthesized oligonucleotide
atggctcacacggcactcg

SEQ ID NO: 5254 - DNA, 19 bp, Artificial Sequence
  Description of Artificial Sequence: Chemically synthesized oligonucleotide
cgagtgccgtgtgagccat

SEQ ID NO: 5255 - DNA, 19 bp, Artificial Sequence
  Description of Artificial Sequence: Chemically synthesized oligonucleotide
tggctcacacggcactcgg

SEQ ID NO: 5256 - DNA, 19 bp, Artificial Sequence
  Description of Artificial Sequence: Chemically synthesized oligonucleotide
ccgagtgccgtgtgagcca

SEQ ID NO: 5257 - DNA, 19 bp, Artificial Sequence
  Description of Artificial Sequence: Chemically synthesized oligonucleotide
ggctcacacggcactcgga

SEQ ID NO: 5258 - DNA, 19 bp, Artificial Sequence
  Description of Artificial Sequence: Chemically synthesized oligonucleotide
tccgagtgccgtgtgagcc

SEQ ID NO: 5259 - DNA, 19 bp, Artificial Sequence
  Description of Artificial Sequence: Chemically synthesized oligonucleotide
gctcacacggcactcggag

SEQ ID NO: 5260 - DNA, 19 bp, Artificial Sequence
  Description of Artificial Sequence: Chemically synthesized oligonucleotide
ctccgagtgccgtgtgagc

SEQ ID NO: 5261 - DNA, 19 bp, Artificial Sequence
  Description of Artificial Sequence: Chemically synthesized oligonucleotide
ctcacacggcactcggagc

SEQ ID NO: 5262 - DNA, 19 bp, Artificial Sequence
  Description of Artificial Sequence: Chemically synthesized oligonucleotide
gctccgagtgccgtgtgag

SEQ ID NO: 5263 - DNA, 19 bp, Artificial Sequence
  Description of Artificial Sequence: Chemically synthesized oligonucleotide
tcacacggcactcggagca

SEQ ID NO: 5264 - DNA, 19 bp, Artificial Sequence
  Description of Artificial Sequence: Chemically synthesized oligonucleotide
tgctccgagtgccgtgtga

SEQ ID NO: 5265 - DNA, 19 bp, Artificial Sequence
  Description of Artificial Sequence: Chemically synthesized oligonucleotide
cacacggcactcggagcag

SEQ ID NO: 5266 - DNA, 19 bp, Artificial Sequence
  Description of Artificial Sequence: Chemically synthesized oligonucleotide
ctgctccgagtgccgtgtg

SEQ ID NO: 5267 - DNA, 19 bp, Artificial Sequence
  Description of Artificial Sequence: Chemically synthesized oligonucleotide
acacggcactcggagcagt

SEQ ID NO: 5268 - DNA, 19 bp, Artificial Sequence
  Description of Artificial Sequence: Chemically synthesized oligonucleotide
actgctccgagtgccgtgt

SEQ ID NO: 5269 - DNA, 19 bp, Artificial Sequence
  Description of Artificial Sequence: Chemically synthesized oligonucleotide
cacggcactcggagcagtt

SEQ ID NO: 5270 - DNA, 19 bp, Artificial Sequence
  Description of Artificial Sequence: Chemically synthesized oligonucleotide
aactgctccgagtgccgtg

SEQ ID NO: 5271 - DNA, 19 bp, Artificial Sequence
  Description of Artificial Sequence: Chemically synthesized oligonucleotide
acggcactcggagcagttt

SEQ ID NO: 5272 - DNA, 19 bp, Artificial Sequence
  Description of Artificial Sequence: Chemically synthesized oligonucleotide
aaactgctccgagtgccgt

SEQ ID NO: 5273 - DNA, 19 bp, Artificial Sequence
  Description of Artificial Sequence: Chemically synthesized oligonucleotide
cggcactcggagcagtttg

SEQ ID NO: 5274 - DNA, 19 bp, Artificial Sequence
  Description of Artificial Sequence: Chemically synthesized oligonucleotide
caaactgctccgagtgccg

SEQ ID NO: 5275 - DNA, 19 bp, Artificial Sequence
  Description of Artificial Sequence: Chemically synthesized oligonucleotide
ggcactcggagcagtttga

SEQ ID NO: 5276 - DNA, 19 bp, Artificial Sequence
  Description of Artificial Sequence: Chemically synthesized oligonucleotide
tcaaactgctccgagtgcc

SEQ ID NO: 5277 - DNA, 19 bp, Artificial Sequence
  Description of Artificial Sequence: Chemically synthesized oligonucleotide
gcactcggagcagtttgaa

SEQ ID NO: 5278 - DNA, 19 bp, Artificial Sequence
  Description of Artificial Sequence: Chemically synthesized oligonucleotide
ttcaaactgctccgagtgc

SEQ ID NO: 5279 - DNA, 19 bp, Artificial Sequence
  Description of Artificial Sequence: Chemically synthesized oligonucleotide
cactcggagcagtttgaat

SEQ ID NO: 5280 - DNA, 19 bp, Artificial Sequence
  Description of Artificial Sequence: Chemically synthesized oligonucleotide
attcaaactgctccgagtg

SEQ ID NO: 5281 - DNA, 19 bp, Artificial Sequence
  Description of Artificial Sequence: Chemically synthesized oligonucleotide
actcggagcagtttgaatg

SEQ ID NO: 5282 - DNA, 19 bp, Artificial Sequence
  Description of Artificial Sequence: Chemically synthesized oligonucleotide
cattcaaactgctccgagt

SEQ ID NO: 5283 - DNA, 19 bp, Artificial Sequence
  Description of Artificial Sequence: Chemically synthesized oligonucleotide
ctcggagcagtttgaatgt

SEQ ID NO: 5284 - DNA, 19 bp, Artificial Sequence
  Description of Artificial Sequence: Chemically synthesized oligonucleotide
acattcaaactgctccgag

SEQ ID NO: 5285 - DNA, 19 bp, Artificial Sequence
  Description of Artificial Sequence: Chemically synthesized oligonucleotide
tcggagcagtttgaatgtc

SEQ ID NO: 5286 - DNA, 19 bp, Artificial Sequence
  Description of Artificial Sequence: Chemically synthesized oligonucleotide
gacattcaaactgctccga

SEQ ID NO: 5287 - DNA, 19 bp, Artificial Sequence
  Description of Artificial Sequence: Chemically synthesized oligonucleotide
cggagcagtttgaatgtcc

SEQ ID NO: 5288 - DNA, 19 bp, Artificial Sequence
  Description of Artificial Sequence: Chemically synthesized oligonucleotide
ggacattcaaactgctccg

SEQ ID NO: 5289 - DNA, 19 bp, Artificial Sequence
  Description of Artificial Sequence: Chemically synthesized oligonucleotide
ggagcagtttgaatgtcca

SEQ ID NO: 5290 - DNA, 19 bp, Artificial Sequence
  Description of Artificial Sequence: Chemically synthesized oligonucleotide
tggacattcaaactgctcc

SEQ ID NO: 5291 - DNA, 19 bp, Artificial Sequence
  Description of Artificial Sequence: Chemically synthesized oligonucleotide
gagcagtttgaatgtccac

SEQ ID NO: 5292 - DNA, 19 bp, Artificial Sequence
  Description of Artificial Sequence: Chemically synthesized oligonucleotide
gtggacattcaaactgctc

SEQ ID NO: 5293 - DNA, 19 bp, Artificial Sequence
  Description of Artificial Sequence: Chemically synthesized oligonucleotide
agcagtttgaatgtccacg

SEQ ID NO: 5294 - DNA, 19 bp, Artificial Sequence
  Description of Artificial Sequence: Chemically synthesized oligonucleotide
cgtggacattcaaactgct

SEQ ID NO: 5295 - DNA, 19 bp, Artificial Sequence
  Description of Artificial Sequence: Chemically synthesized oligonucleotide
gcagtttgaatgtccacgc

SEQ ID NO: 5296 - DNA, 19 bp, Artificial Sequence
  Description of Artificial Sequence: Chemically synthesized oligonucleotide
gcgtggacattcaaactgc

SEQ ID NO: 5297 - DNA, 19 bp, Artificial Sequence
  Description of Artificial Sequence: Chemically synthesized oligonucleotide
cagtttgaatgtccacgcg

SEQ ID NO: 5298 - DNA, 19 bp, Artificial Sequence
  Description of Artificial Sequence: Chemically synthesized oligonucleotide
cgcgtggacattcaaactg

SEQ ID NO: 5299 - DNA, 19 bp, Artificial Sequence
  Description of Artificial Sequence: Chemically synthesized oligonucleotide
agtttgaatgtccacgcgg

SEQ ID NO: 5300 - DNA, 19 bp, Artificial Sequence
  Description of Artificial Sequence: Chemically synthesized oligonucleotide
ccgcgtggacattcaaact

SEQ ID NO: 5301 - DNA, 19 bp, Artificial Sequence
  Description of Artificial Sequence: Chemically synthesized oligonucleotide
gtttgaatgtccacgcggc

SEQ ID NO: 5302 - DNA, 19 bp, Artificial Sequence
  Description of Artificial Sequence: Chemically synthesized oligonucleotide
gccgcgtggacattcaaac

SEQ ID NO: 5303 - DNA, 19 bp, Artificial Sequence
  Description of Artificial Sequence: Chemically synthesized oligonucleotide
tttgaatgtccacgcggct

SEQ ID NO: 5304 - DNA, 19 bp, Artificial Sequence
  Description of Artificial Sequence: Chemically synthesized oligonucleotide
agccgcgtggacattcaaa

SEQ ID NO: 5305 - DNA, 19 bp, Artificial Sequence
  Description of Artificial Sequence: Chemically synthesized oligonucleotide
ttgaatgtccacgcggctg

SEQ ID NO: 5306 - DNA, 19 bp, Artificial Sequence
  Description of Artificial Sequence: Chemically synthesized oligonucleotide
cagccgcgtggacattcaa

SEQ ID NO: 5307 - DNA, 19 bp, Artificial Sequence
  Description of Artificial Sequence: Chemically synthesized oligonucleotide
tgaatgtccacgcggctgc

SEQ ID NO: 5308 - DNA, 19 bp, Artificial Sequence
  Description of Artificial Sequence: Chemically synthesized oligonucleotide
gcagccgcgtggacattca

SEQ ID NO: 5309 - DNA, 19 bp, Artificial Sequence
  Description of Artificial Sequence: Chemically synthesized oligonucleotide
gaatgtccacgcggctgcc

SEQ ID NO: 5310 - DNA, 19 bp, Artificial Sequence
  Description of Artificial Sequence: Chemically synthesized oligonucleotide
ggcagccgcgtggacattc

SEQ ID NO: 5311 - DNA, 19 bp, Artificial Sequence
  Description of Artificial Sequence: Chemically synthesized oligonucleotide
aatgtccacgcggctgccc

SEQ ID NO: 5312 - DNA, 19 bp, Artificial Sequence
  Description of Artificial Sequence: Chemically synthesized oligonucleotide
gggcagccgcgtggacatt

SEQ ID NO: 5313 - DNA, 19 bp, Artificial Sequence
  Description of Artificial Sequence: Chemically synthesized oligonucleotide
atgtccacgcggctgccct

SEQ ID NO: 5314 - DNA, 19 bp, Artificial Sequence
  Description of Artificial Sequence: Chemically synthesized oligonucleotide
agggcagccgcgtggacat

SEQ ID NO: 5315 - DNA, 19 bp, Artificial Sequence
  Description of Artificial Sequence: Chemically synthesized oligonucleotide
tgtccacgcggctgccctg

SEQ ID NO: 5316 - DNA, 19 bp, Artificial Sequence
  Description of Artificial Sequence: Chemically synthesized oligonucleotide
cagggcagccgcgtggaca

SEQ ID NO: 5317 - DNA, 19 bp, Artificial Sequence
  Description of Artificial Sequence: Chemically synthesized oligonucleotide
gtccacgcggctgccctga

SEQ ID NO: 5318 - DNA, 19 bp, Artificial Sequence
  Description of Artificial Sequence: Chemically synthesized oligonucleotide
tcagggcagccgcgtggac

SEQ ID NO: 5319 - DNA, 19 bp, Artificial Sequence
  Description of Artificial Sequence: Chemically synthesized oligonucleotide
tccacgcggctgccctgag

SEQ ID NO: 5320 - DNA, 19 bp, Artificial Sequence
  Description of Artificial Sequence: Chemically synthesized oligonucleotide
ctcagggcagccgcgtgga

SEQ ID NO: 5321 - DNA, 19 bp, Artificial Sequence
  Description of Artificial Sequence: Chemically synthesized oligonucleotide
ccacgcggctgccctgagg

SEQ ID NO: 5322 - DNA, 19 bp, Artificial Sequence
  Description of Artificial Sequence: Chemically synthesized oligonucleotide
cctcagggcagccgcgtgg

SEQ ID NO: 5323 - DNA, 19 bp, Artificial Sequence
  Description of Artificial Sequence: Chemically synthesized oligonucleotide
cacgcggctgccctgaggt

SEQ ID NO: 5324 - DNA, 19 bp, Artificial Sequence
  Description of Artificial Sequence: Chemically synthesized oligonucleotide
acctcagggcagccgcgtg

SEQ ID NO: 5325 - DNA, 19 bp, Artificial Sequence
  Description of Artificial Sequence: Chemically synthesized oligonucleotide
acgcggctgccctgaggtc

SEQ ID NO: 5326 - DNA, 19 bp, Artificial Sequence
  Description of Artificial Sequence: Chemically synthesized oligonucleotide
gacctcagggcagccgcgt

SEQ ID NO: 5327 - DNA, 19 bp, Artificial Sequence
  Description of Artificial Sequence: Chemically synthesized oligonucleotide
cgcggctgccctgaggtcg

SEQ ID NO: 5328 - DNA, 19 bp, Artificial Sequence
  Description of Artificial Sequence: Chemically synthesized oligonucleotide
cgacctcagggcagccgcg

SEQ ID NO: 5329 - DNA, 19 bp, Artificial Sequence
  Description of Artificial Sequence: Chemically synthesized oligonucleotide
gcggctgccctgaggtcga

SEQ ID NO: 5330 - DNA, 19 bp, Artificial Sequence
  Description of Artificial Sequence: Chemically synthesized oligonucleotide
tcgacctcagggcagccgc

SEQ ID NO: 5331 - DNA, 19 bp, Artificial Sequence
  Description of Artificial Sequence: Chemically synthesized oligonucleotide
cggctgccctgaggtcgag

SEQ ID NO: 5332 - DNA, 19 bp, Artificial Sequence
  Description of Artificial Sequence: Chemically synthesized oligonucleotide
ctcgacctcagggcagccg

SEQ ID NO: 5333 - DNA, 19 bp, Artificial Sequence
  Description of Artificial Sequence: Chemically synthesized oligonucleotide
ggctgccctgaggtcgagg

SEQ ID NO: 5334 - DNA, 19 bp, Artificial Sequence
  Description of Artificial Sequence: Chemically synthesized oligonucleotide
cctcgacctcagggcagcc

SEQ ID NO: 5335 - DNA, 19 bp, Artificial Sequence
  Description of Artificial Sequence: Chemically synthesized oligonucleotide
gctgccctgaggtcgagga

SEQ ID NO: 5336 - DNA, 19 bp, Artificial Sequence
  Description of Artificial Sequence: Chemically synthesized oligonucleotide
tcctcgacctcagggcagc

SEQ ID NO: 5337 - DNA, 19 bp, Artificial Sequence
  Description of Artificial Sequence: Chemically synthesized oligonucleotide
ctgccctgaggtcgaggag

SEQ ID NO: 5338 - DNA, 19 bp, Artificial Sequence
  Description of Artificial Sequence: Chemically synthesized oligonucleotide
ctcctcgacctcagggcag

SEQ ID NO: 5339 - DNA, 19 bp, Artificial Sequence
  Description of Artificial Sequence: Chemically synthesized oligonucleotide
tgccctgaggtcgaggaga

SEQ ID NO: 5340 - DNA, 19 bp, Artificial Sequence
  Description of Artificial Sequence: Chemically synthesized oligonucleotide
tctcctcgacctcagggca

SEQ ID NO: 5341 - DNA, 19 bp, Artificial Sequence
  Description of Artificial Sequence: Chemically synthesized oligonucleotide
gccctgaggtcgaggagag

SEQ ID NO: 5342 - DNA, 19 bp, Artificial Sequence
  Description of Artificial Sequence: Chemically synthesized oligonucleotide
ctctcctcgacctcagggc

SEQ ID NO: 5343 - DNA, 19 bp, Artificial Sequence
  Description of Artificial Sequence: Chemically synthesized oligonucleotide
ccctgaggtcgaggagagg

SEQ ID NO: 5344 - DNA, 19 bp, Artificial Sequence
  Description of Artificial Sequence: Chemically synthesized oligonucleotide
cctctcctcgacctcaggg

SEQ ID NO: 5345 - DNA, 19 bp, Artificial Sequence
  Description of Artificial Sequence: Chemically synthesized oligonucleotide
cctgaggtcgaggagaggc

SEQ ID NO: 5346 - DNA, 19 bp, Artificial Sequence
  Description of Artificial Sequence: Chemically synthesized oligonucleotide
gcctctcctcgacctcagg

SEQ ID NO: 5347 - DNA, 19 bp, Artificial Sequence
  Description of Artificial Sequence: Chemically synthesized oligonucleotide
ctgaggtcgaggagaggcc

SEQ ID NO: 5348 - DNA, 19 bp, Artificial Sequence
  Description of Artificial Sequence: Chemically synthesized oligonucleotide
ggcctctcctcgacctcag

SEQ ID NO: 5349 - DNA, 19 bp, Artificial Sequence
  Description of Artificial Sequence: Chemically synthesized oligonucleotide
tgaggtcgaggagaggccg

SEQ ID NO: 5350 - DNA, 19 bp, Artificial Sequence
  Description of Artificial Sequence: Chemically synthesized oligonucleotide
cggcctctcctcgacctca

SEQ ID NO: 5351 - DNA, 19 bp, Artificial Sequence
  Description of Artificial Sequence: Chemically synthesized oligonucleotide
gaggtcgaggagaggccgg

SEQ ID NO: 5352 - DNA, 19 bp, Artificial Sequence
  Description of Artificial Sequence: Chemically synthesized oligonucleotide
ccggcctctcctcgacctc

SEQ ID NO: 5353 - DNA, 19 bp, Artificial Sequence
  Description of Artificial Sequence: Chemically synthesized oligonucleotide
aggtcgaggagaggccggt

SEQ ID NO: 5354 - DNA, 19 bp, Artificial Sequence
  Description of Artificial Sequence: Chemically synthesized oligonucleotide
accggcctctcctcgacct

SEQ ID NO: 5355 - DNA, 19 bp, Artificial Sequence
  Description of Artificial Sequence: Chemically synthesized oligonucleotide
ggtcgaggagaggccggtt

SEQ ID NO: 5356 - DNA, 19 bp, Artificial Sequence
  Description of Artificial Sequence: Chemically synthesized oligonucleotide
aaccggcctctcctcgacc

SEQ ID NO: 5357 - DNA, 19 bp, Artificial Sequence
  Description of Artificial Sequence: Chemically synthesized oligonucleotide
gtcgaggagaggccggttg

SEQ ID NO: 5358 - DNA, 19 bp, Artificial Sequence
  Description of Artificial Sequence: Chemically synthesized oligonucleotide
caaccggcctctcctcgac

SEQ ID NO: 5359 - DNA, 19 bp, Artificial Sequence
  Description of Artificial Sequence: Chemically synthesized oligonucleotide
tcgaggagaggccggttgc

SEQ ID NO: 5360 - DNA, 19 bp, Artificial Sequence
  Description of Artificial Sequence: Chemically synthesized oligonucleotide
gcaaccggcctctcctcga

SEQ ID NO: 5361 - DNA, 19 bp, Artificial Sequence
  Description of Artificial Sequence: Chemically synthesized oligonucleotide
cgaggagaggccggttgct

SEQ ID NO: 5362 - DNA, 19 bp, Artificial Sequence
  Description of Artificial Sequence: Chemically synthesized oligonucleotide
agcaaccggcctctcctcg

SEQ ID NO: 5363 - DNA, 19 bp, Artificial Sequence
  Description of Artificial Sequence: Chemically synthesized oligonucleotide
gaggagaggccggttgctc

SEQ ID NO: 5364 - DNA, 19 bp, Artificial Sequence
  Description of Artificial Sequence: Chemically synthesized oligonucleotide
gagcaaccggcctctcctc

SEQ ID NO: 5365 - DNA, 19 bp, Artificial Sequence
  Description of Artificial Sequence: Chemically synthesized oligonucleotide
aggagaggccggttgctcg

SEQ ID NO: 5366 - DNA, 19 bp, Artificial Sequence
  Description of Artificial Sequence: Chemically synthesized oligonucleotide
cgagcaaccggcctctcct

SEQ ID NO: 5367 - DNA, 19 bp, Artificial Sequence
  Description of Artificial Sequence: Chemically synthesized oligonucleotide
ggagaggccggttgctcgg

SEQ ID NO: 5368 - DNA, 19 bp, Artificial Sequence
  Description of Artificial Sequence: Chemically synthesized oligonucleotide
ccgagcaaccggcctctcc

SEQ ID NO: 5369 - DNA, 19 bp, Artificial Sequence
  Description of Artificial Sequence: Chemically synthesized oligonucleotide
gagaggccggttgctcggc

SEQ ID NO: 5370 - DNA, 19 bp, Artificial Sequence
  Description of Artificial Sequence: Chemically synthesized oligonucleotide
gccgagcaaccggcctctc

SEQ ID NO: 5371 - DNA, 19 bp, Artificial Sequence
  Description of Artificial Sequence: Chemically synthesized oligonucleotide
agaggccggttgctcggct

SEQ ID NO: 5372 - DNA, 19 bp, Artificial Sequence
  Description of Artificial Sequence: Chemically synthesized oligonucleotide
agccgagcaaccggcctct

SEQ ID NO: 5373 - DNA, 19 bp, Artificial Sequence
  Description of Artificial Sequence: Chemically synthesized oligonucleotide
gaggccggttgctcggctc

SEQ ID NO: 5374 - DNA, 19 bp, Artificial Sequence
  Description of Artificial Sequence: Chemically synthesized oligonucleotide
gagccgagcaaccggcctc

SEQ ID NO: 5375 - DNA, 19 bp, Artificial Sequence
  Description of Artificial Sequence: Chemically synthesized oligonucleotide
aggccggttgctcggctcc

SEQ ID NO: 5376 - DNA, 19 bp, Artificial Sequence
  Description of Artificial Sequence: Chemically synthesized oligonucleotide
ggagccgagcaaccggcct

SEQ ID NO: 5377 - DNA, 19 bp, Artificial Sequence
  Description of Artificial Sequence: Chemically synthesized oligonucleotide
ggccggttgctcggctccg

SEQ ID NO: 5378 - DNA, 19 bp, Artificial Sequence
  Description of Artificial Sequence: Chemically synthesized oligonucleotide
cggagccgagcaaccggcc

SEQ ID NO: 5379 - DNA, 19 bp, Artificial Sequence
  Description of Artificial Sequence: Chemically synthesized oligonucleotide
gccggttgctcggctccgg

SEQ ID NO: 5380 - DNA, 19 bp, Artificial Sequence
  Description of Artificial Sequence: Chemically synthesized oligonucleotide
ccggagccgagcaaccggc

SEQ ID NO: 5381 - DNA, 19 bp, Artificial Sequence
  Description of Artificial Sequence: Chemically synthesized oligonucleotide
ccggttgctcggctccggg

SEQ ID NO: 5382 - DNA, 19 bp, Artificial Sequence
  Description of Artificial Sequence: Chemically synthesized oligonucleotide
cccggagccgagcaaccgg

SEQ ID NO: 5383 - DNA, 19 bp, Artificial Sequence
  Description of Artificial Sequence: Chemically synthesized oligonucleotide
cggttgctcggctccgggc

SEQ ID NO: 5384 - DNA, 19 bp, Artificial Sequence
  Description of Artificial Sequence: Chemically synthesized oligonucleotide
gcccggagccgagcaaccg

SEQ ID NO: 5385 - DNA, 19 bp, Artificial Sequence
  Description of Artificial Sequence: Chemically synthesized oligonucleotide
ggttgctcggctccgggcc

SEQ ID NO: 5386 - DNA, 19 bp, Artificial Sequence
  Description of Artificial Sequence: Chemically synthesized oligonucleotide
ggcccggagccgagcaacc

SEQ ID NO: 5387 - DNA, 19 bp, Artificial Sequence
  Description of Artificial Sequence: Chemically synthesized oligonucleotide
gttgctcggctccgggccc

SEQ ID NO: 5388 - DNA, 19 bp, Artificial Sequence
  Description of Artificial Sequence: Chemically synthesized oligonucleotide
gggcccggagccgagcaac

SEQ ID NO: 5389 - DNA, 19 bp, Artificial Sequence
  Description of Artificial Sequence: Chemically synthesized oligonucleotide
ttgctcggctccgggccct

SEQ ID NO: 5390 - DNA, 19 bp, Artificial Sequence
  Description of Artificial Sequence: Chemically synthesized oligonucleotide
agggcccggagccgagcaa

SEQ ID NO: 5391 - DNA, 19 bp, Artificial Sequence
  Description of Artificial Sequence: Chemically synthesized oligonucleotide
tgctcggctccgggccctc

SEQ ID NO: 5392 - DNA, 19 bp, Artificial Sequence
  Description of Artificial Sequence: Chemically synthesized oligonucleotide
gagggcccggagccgagca

SEQ ID NO: 5393 - DNA, 19 bp, Artificial Sequence
  Description of Artificial Sequence: Chemically synthesized oligonucleotide
gctcggctccgggccctca

SEQ ID NO: 5394 - DNA, 19 bp, Artificial Sequence
  Description of Artificial Sequence: Chemically synthesized oligonucleotide
tgagggcccggagccgagc

SEQ ID NO: 5395 - DNA, 19 bp, Artificial Sequence
  Description of Artificial Sequence: Chemically synthesized oligonucleotide
ctcggctccgggccctcaa

SEQ ID NO: 5396 - DNA, 19 bp, Artificial Sequence
  Description of Artificial Sequence: Chemically synthesized oligonucleotide
ttgagggcccggagccgag

SEQ ID NO: 5397 - DNA, 19 bp, Artificial Sequence
  Description of Artificial Sequence: Chemically synthesized oligonucleotide
tcggctccgggccctcaaa

SEQ ID NO: 5398 - DNA, 19 bp, Artificial Sequence
  Description of Artificial Sequence: Chemically synthesized oligonucleotide
tttgagggcccggagccga

SEQ ID NO: 5399 - DNA, 19 bp, Artificial Sequence
  Description of Artificial Sequence: Chemically synthesized oligonucleotide
cggctccgggccctcaaaa

SEQ ID NO: 5400 - DNA, 19 bp, Artificial Sequence
  Description of Artificial Sequence: Chemically synthesized oligonucleotide
ttttgagggcccggagccg

SEQ ID NO: 5401 - DNA, 19 bp, Artificial Sequence
  Description of Artificial Sequence: Chemically synthesized oligonucleotide
ggctccgggccctcaaaag

SEQ ID NO: 5402 - DNA, 19 bp, Artificial Sequence
  Description of Artificial Sequence: Chemically synthesized oligonucleotide
cttttgagggcccggagcc

SEQ ID NO: 5403 - DNA, 19 bp, Artificial Sequence
  Description of Artificial Sequence: Chemically synthesized oligonucleotide
gctccgggccctcaaaagg

SEQ ID NO: 5404 - DNA, 19 bp, Artificial Sequence
  Description of Artificial Sequence: Chemically synthesized oligonucleotide
ccttttgagggcccggagc

SEQ ID NO: 5405 - DNA, 19 bp, Artificial Sequence
  Description of Artificial Sequence: Chemically synthesized oligonucleotide
ctccgggccctcaaaaggg

SEQ ID NO: 5406 - DNA, 19 bp, Artificial Sequence
  Description of Artificial Sequence: Chemically synthesized oligonucleotide
cccttttgagggcccggag

SEQ ID NO: 5407 - DNA, 19 bp, Artificial Sequence
  Description of Artificial Sequence: Chemically synthesized oligonucleotide
tccgggccctcaaaagggc

SEQ ID NO: 5408 - DNA, 19 bp, Artificial Sequence
  Description of Artificial Sequence: Chemically synthesized oligonucleotide
gcccttttgagggcccgga

SEQ ID NO: 5409 - DNA, 19 bp, Artificial Sequence
  Description of Artificial Sequence: Chemically synthesized oligonucleotide
ccgggccctcaaaagggca

SEQ ID NO: 5410 - DNA, 19 bp, Artificial Sequence
  Description of Artificial Sequence: Chemically synthesized oligonucleotide
tgcccttttgagggcccgg

SEQ ID NO: 5411 - DNA, 19 bp, Artificial Sequence
  Description of Artificial Sequence: Chemically synthesized oligonucleotide
cgggccctcaaaagggcag

SEQ ID NO: 5412 - DNA, 19 bp, Artificial Sequence
  Description of Artificial Sequence: Chemically synthesized oligonucleotide
ctgcccttttgagggcccg

SEQ ID NO: 5413 - DNA, 19 bp, Artificial Sequence
  Description of Artificial Sequence: Chemically synthesized oligonucleotide
gggccctcaaaagggcagg

SEQ ID NO: 5414 - DNA, 19 bp, Artificial Sequence
  Description of Artificial Sequence: Chemically synthesized oligonucleotide
cctgcccttttgagggccc

SEQ ID NO: 5415 - DNA, 19 bp, Artificial Sequence
  Description of Artificial Sequence: Chemically synthesized oligonucleotide
ggccctcaaaagggcaggc

SEQ ID NO: 5416 - DNA, 19 bp, Artificial Sequence
  Description of Artificial Sequence: Chemically synthesized oligonucleotide
gcctgcccttttgagggcc

SEQ ID NO: 5417 - DNA, 19 bp, Artificial Sequence
  Description of Artificial Sequence: Chemically synthesized oligonucleotide
gccctcaaaagggcaggca

SEQ ID NO: 5418 - DNA, 19 bp, Artificial Sequence
  Description of Artificial Sequence: Chemically synthesized oligonucleotide
tgcctgcccttttgagggc

SEQ ID NO: 5419 - DNA, 19 bp, Artificial Sequence
  Description of Artificial Sequence: Chemically synthesized oligonucleotide
ccctcaaaagggcaggcag

SEQ ID NO: 5420 - DNA, 19 bp, Artificial Sequence
  Description of Artificial Sequence: Chemically synthesized oligonucleotide
ctgcctgcccttttgaggg

SEQ ID NO: 5421 - DNA, 19 bp, Artificial Sequence
  Description of Artificial Sequence: Chemically synthesized oligonucleotide
cctcaaaagggcaggcagc

SEQ ID NO: 5422 - DNA, 19 bp, Artificial Sequence
  Description of Artificial Sequence: Chemically synthesized oligonucleotide
gctgcctgcccttttgagg

SEQ ID NO: 5423 - DNA, 19 bp, Artificial Sequence
  Description of Artificial Sequence: Chemically synthesized oligonucleotide
ctcaaaagggcaggcagcc

SEQ ID NO: 5424 - DNA, 19 bp, Artificial Sequence
  Description of Artificial Sequence: Chemically synthesized oligonucleotide
ggctgcctgcccttttgag

SEQ ID NO: 5425 - DNA, 19 bp, Artificial Sequence
  Description of Artificial Sequence: Chemically synthesized oligonucleotide
tcaaaagggcaggcagccc

SEQ ID NO: 5426 - DNA, 19 bp, Artificial Sequence
  Description of Artificial Sequence: Chemically synthesized oligonucleotide
gggctgcctgcccttttga

SEQ ID NO: 5427 - DNA, 19 bp, Artificial Sequence
  Description of Artificial Sequence: Chemically synthesized oligonucleotide
caaaagggcaggcagcccc

SEQ ID NO: 5428 - DNA, 19 bp, Artificial Sequence
  Description of Artificial Sequence: Chemically synthesized oligonucleotide
ggggctgcctgcccttttg

SEQ ID NO: 5429 - DNA, 19 bp, Artificial Sequence
  Description of Artificial Sequence: Chemically synthesized oligonucleotide
aaaagggcaggcagccccg

SEQ ID NO: 5430 - DNA, 19 bp, Artificial Sequence
  Description of Artificial Sequence: Chemically synthesized oligonucleotide
cggggctgcctgccctttt

SEQ ID NO: 5431 - DNA, 19 bp, Artificial Sequence
  Description of Artificial Sequence: Chemically synthesized oligonucleotide
aaagggcaggcagccccga

SEQ ID NO: 5432 - DNA, 19 bp, Artificial Sequence
  Description of Artificial Sequence: Chemically synthesized oligonucleotide
tcggggctgcctgcccttt

SEQ ID NO: 5433 - DNA, 19 bp, Artificial Sequence
  Description of Artificial Sequence: Chemically synthesized oligonucleotide
aagggcaggcagccccgag

SEQ ID NO: 5434 - DNA, 19 bp, Artificial Sequence
  Description of Artificial Sequence: Chemically synthesized oligonucleotide
ctcggggctgcctgccctt

SEQ ID NO: 5435 - DNA, 19 bp, Artificial Sequence
  Description of Artificial Sequence: Chemically synthesized oligonucleotide
agggcaggcagccccgagg

SEQ ID NO: 5436 - DNA, 19 bp, Artificial Sequence
  Description of Artificial Sequence: Chemically synthesized oligonucleotide
cctcggggctgcctgccct

SEQ ID NO: 5437 - DNA, 19 bp, Artificial Sequence
  Description of Artificial Sequence: Chemically synthesized oligonucleotide
gggcaggcagccccgaggt

SEQ ID NO: 5438 - DNA, 19 bp, Artificial Sequence
  Description of Artificial Sequence: Chemically synthesized oligonucleotide
acctcggggctgcctgccc

SEQ ID NO: 5439 - DNA, 19 bp, Artificial Sequence
  Description of Artificial Sequence: Chemically synthesized oligonucleotide
ggcaggcagccccgaggtc

SEQ ID NO: 5440 - DNA, 19 bp, Artificial Sequence
  Description of Artificial Sequence: Chemically synthesized oligonucleotide
gacctcggggctgcctgcc

SEQ ID NO: 5441 - DNA, 19 bp, Artificial Sequence
  Description of Artificial Sequence: Chemically synthesized oligonucleotide
gcaggcagccccgaggtcc

SEQ ID NO: 5442 - DNA, 19 bp, Artificial Sequence
  Description of Artificial Sequence: Chemically synthesized oligonucleotide
ggacctcggggctgcctgc

SEQ ID NO: 5443 - DNA, 19 bp, Artificial Sequence
  Description of Artificial Sequence: Chemically synthesized oligonucleotide
caggcagccccgaggtcca

SEQ ID NO: 5444 - DNA, 19 bp, Artificial Sequence
  Description of Artificial Sequence: Chemically synthesized oligonucleotide
tggacctcggggctgcctg

SEQ ID NO: 5445 - DNA, 19 bp, Artificial Sequence
  Description of Artificial Sequence: Chemically synthesized oligonucleotide
aggcagccccgaggtccag

SEQ ID NO: 5446 - DNA, 19 bp, Artificial Sequence
  Description of Artificial Sequence: Chemically synthesized oligonucleotide
ctggacctcggggctgcct

SEQ ID NO: 5447 - DNA, 19 bp, Artificial Sequence
  Description of Artificial Sequence: Chemically synthesized oligonucleotide
ggcagccccgaggtccagg

SEQ ID NO: 5448 - DNA, 19 bp, Artificial Sequence
  Description of Artificial Sequence: Chemically synthesized oligonucleotide
cctggacctcggggctgcc

SEQ ID NO: 5449 - DNA, 19 bp, Artificial Sequence
  Description of Artificial Sequence: Chemically synthesized oligonucleotide
gcagccccgaggtccaggg

SEQ ID NO: 5450 - DNA, 19 bp, Artificial Sequence
  Description of Artificial Sequence: Chemically synthesized oligonucleotide
ccctggacctcggggctgc

SEQ ID NO: 5451 - DNA, 19 bp, Artificial Sequence
  Description of Artificial Sequence: Chemically synthesized oligonucleotide
cagccccgaggtccaggga

SEQ ID NO: 5452 - DNA, 19 bp, Artificial Sequence
  Description of Artificial Sequence: Chemically synthesized oligonucleotide
tccctggacctcggggctg

SEQ ID NO: 5453 - DNA, 19 bp, Artificial Sequence
  Description of Artificial Sequence: Chemically synthesized oligonucleotide
agccccgaggtccagggag

SEQ ID NO: 5454 - DNA, 19 bp, Artificial Sequence
  Description of Artificial Sequence: Chemically synthesized oligonucleotide
ctccctggacctcggggct

SEQ ID NO: 5455 - DNA, 19 bp, Artificial Sequence
  Description of Artificial Sequence: Chemically synthesized oligonucleotide
gccccgaggtccagggagc

SEQ ID NO: 5456 - DNA, 19 bp, Artificial Sequence
  Description of Artificial Sequence: Chemically synthesized oligonucleotide
gctccctggacctcggggc

SEQ ID NO: 5457 - DNA, 19 bp, Artificial Sequence
  Description of Artificial Sequence: Chemically synthesized oligonucleotide
ccccgaggtccagggagca

SEQ ID NO: 5458 - DNA, 19 bp, Artificial Sequence
  Description of Artificial Sequence: Chemically synthesized oligonucleotide
tgctccctggacctcgggg

SEQ ID NO: 5459 - DNA, 19 bp, Artificial Sequence
  Description of Artificial Sequence: Chemically synthesized oligonucleotide
cccgaggtccagggagcaa

SEQ ID NO: 5460 - DNA, 19 bp, Artificial Sequence
  Description of Artificial Sequence: Chemically synthesized oligonucleotide
ttgctccctggacctcggg

SEQ ID NO: 5461 - DNA, 19 bp, Artificial Sequence
  Description of Artificial Sequence: Chemically synthesized oligonucleotide
ccgaggtccagggagcaat

SEQ ID NO: 5462 - DNA, 19 bp, Artificial Sequence
  Description of Artificial Sequence: Chemically synthesized oligonucleotide
attgctccctggacctcgg

SEQ ID NO: 5463 - DNA, 19 bp, Artificial Sequence
  Description of Artificial Sequence: Chemically synthesized oligonucleotide
cgaggtccagggagcaatg

SEQ ID NO: 5464 - DNA, 19 bp, Artificial Sequence
  Description of Artificial Sequence: Chemically synthesized oligonucleotide
cattgctccctggacctcg

SEQ ID NO: 5465 - DNA, 19 bp, Artificial Sequence
  Description of Artificial Sequence: Chemically synthesized oligonucleotide
gaggtccagggagcaatgg

SEQ ID NO: 5466 - DNA, 19 bp, Artificial Sequence
  Description of Artificial Sequence: Chemically synthesized oligonucleotide
ccattgctccctggacctc

SEQ ID NO: 5467 - DNA, 19 bp, Artificial Sequence
  Description of Artificial Sequence: Chemically synthesized oligonucleotide
aggtccagggagcaatggg

SEQ ID NO: 5468 - DNA, 19 bp, Artificial Sequence
  Description of Artificial Sequence: Chemically synthesized oligonucleotide
cccattgctccctggacct

SEQ ID NO: 5469 - DNA, 19 bp, Artificial Sequence
  Description of Artificial Sequence: Chemically synthesized oligonucleotide
ggtccagggagcaatgggc

SEQ ID NO: 5470 - DNA, 19 bp, Artificial Sequence
  Description of Artificial Sequence: Chemically synthesized oligonucleotide
gcccattgctccctggacc

SEQ ID NO: 5471 - DNA, 19 bp, Artificial Sequence
  Description of Artificial Sequence: Chemically synthesized oligonucleotide
gtccagggagcaatgggca

SEQ ID NO: 5472 - DNA, 19 bp, Artificial Sequence
  Description of Artificial Sequence: Chemically synthesized oligonucleotide
tgcccattgctccctggac

SEQ ID NO: 5473 - DNA, 19 bp, Artificial Sequence
  Description of Artificial Sequence: Chemically synthesized oligonucleotide
tccagggagcaatgggcag

SEQ ID NO: 5474 - DNA, 19 bp, Artificial Sequence
  Description of Artificial Sequence: Chemically synthesized oligonucleotide
ctgcccattgctccctgga

SEQ ID NO: 5475 - DNA, 19 bp, Artificial Sequence
  Description of Artificial Sequence: Chemically synthesized oligonucleotide
ccagggagcaatgggcagt

SEQ ID NO: 5476 - DNA, 19 bp, Artificial Sequence
  Description of Artificial Sequence: Chemically synthesized oligonucleotide
actgcccattgctccctgg

SEQ ID NO: 5477 - DNA, 19 bp, Artificial Sequence
  Description of Artificial Sequence: Chemically synthesized oligonucleotide
cagggagcaatgggcagtc

SEQ ID NO: 5478 - DNA, 19 bp, Artificial Sequence
  Description of Artificial Sequence: Chemically synthesized oligonucleotide
gactgcccattgctccctg

SEQ ID NO: 5479 - DNA, 19 bp, Artificial Sequence
  Description of Artificial Sequence: Chemically synthesized oligonucleotide
agggagcaatgggcagtcc

SEQ ID NO: 5480 - DNA, 19 bp, Artificial Sequence
  Description of Artificial Sequence: Chemically synthesized oligonucleotide
ggactgcccattgctccct

SEQ ID NO: 5481 - DNA, 19 bp, Artificial Sequence
  Description of Artificial Sequence: Chemically synthesized oligonucleotide
gggagcaatgggcagtcca

SEQ ID NO: 5482 - DNA, 19 bp, Artificial Sequence
  Description of Artificial Sequence: Chemically synthesized oligonucleotide
tggactgcccattgctccc

SEQ ID NO: 5483 - DNA, 19 bp, Artificial Sequence
  Description of Artificial Sequence: Chemically synthesized oligonucleotide
ggagcaatgggcagtccag

SEQ ID NO: 5484 - DNA, 19 bp, Artificial Sequence
  Description of Artificial Sequence: Chemically synthesized oligonucleotide
ctggactgcccattgctcc

SEQ ID NO: 5485 - DNA, 19 bp, Artificial Sequence
  Description of Artificial Sequence: Chemically synthesized oligonucleotide
gagcaatgggcagtccagc

SEQ ID NO: 5486 - DNA, 19 bp, Artificial Sequence
  Description of Artificial Sequence: Chemically synthesized oligonucleotide
gctggactgcccattgctc

SEQ ID NO: 5487 - DNA, 19 bp, Artificial Sequence
  Description of Artificial Sequence: Chemically synthesized oligonucleotide
agcaatgggcagtccagcc

SEQ ID NO: 5488 - DNA, 19 bp, Artificial Sequence
  Description of Artificial Sequence: Chemically synthesized oligonucleotide
ggctggactgcccattgct

SEQ ID NO: 5489 - DNA, 19 bp, Artificial Sequence
  Description of Artificial Sequence: Chemically synthesized oligonucleotide
gcaatgggcagtccagccc

SEQ ID NO: 5490 - DNA, 19 bp, Artificial Sequence
  Description of Artificial Sequence: Chemically synthesized oligonucleotide
gggctggactgcccattgc

SEQ ID NO: 5491 - DNA, 19 bp, Artificial Sequence
  Description of Artificial Sequence: Chemically synthesized oligonucleotide
caatgggcagtccagcccc

SEQ ID NO: 5492 - DNA, 19 bp, Artificial Sequence
  Description of Artificial Sequence: Chemically synthesized oligonucleotide
ggggctggactgcccattg

SEQ ID NO: 5493 - DNA, 19 bp, Artificial Sequence
  Description of Artificial Sequence: Chemically synthesized oligonucleotide
aatgggcagtccagccccc

SEQ ID NO: 5494 - DNA, 19 bp, Artificial Sequence
  Description of Artificial Sequence: Chemically synthesized oligonucleotide
gggggctggactgcccatt

SEQ ID NO: 5495 - DNA, 19 bp, Artificial Sequence
  Description of Artificial Sequence: Chemically synthesized oligonucleotide
atgggcagtccagccccca

SEQ ID NO: 5496 - DNA, 19 bp, Artificial Sequence
  Description of Artificial Sequence: Chemically synthesized oligonucleotide
tgggggctggactgcccat

SEQ ID NO: 5497 - DNA, 19 bp, Artificial Sequence
  Description of Artificial Sequence: Chemically synthesized oligonucleotide
tgggcagtccagcccccaa

SEQ ID NO: 5498 - DNA, 19 bp, Artificial Sequence
  Description of Artificial Sequence: Chemically synthesized oligonucleotide
ttgggggctggactgccca

SEQ ID NO: 5499 - DNA, 19 bp, Artificial Sequence
  Description of Artificial Sequence: Chemically synthesized oligonucleotide
gggcagtccagcccccaag

SEQ ID NO: 5500 - DNA, 19 bp, Artificial Sequence
  Description of Artificial Sequence: Chemically synthesized oligonucleotide
cttgggggctggactgccc

SEQ ID NO: 5501 - DNA, 19 bp, Artificial Sequence
  Description of Artificial Sequence: Chemically synthesized oligonucleotide
ggcagtccagcccccaagc

SEQ ID NO: 5502 - DNA, 19 bp, Artificial Sequence
  Description of Artificial Sequence: Chemically synthesized oligonucleotide
gcttgggggctggactgcc

SEQ ID NO: 5503 - DNA, 19 bp, Artificial Sequence
  Description of Artificial Sequence: Chemically synthesized oligonucleotide
gcagtccagcccccaagcg

SEQ ID NO: 5504 - DNA, 19 bp, Artificial Sequence
  Description of Artificial Sequence: Chemically synthesized oligonucleotide
cgcttgggggctggactgc

SEQ ID NO: 5505 - DNA, 19 bp, Artificial Sequence
  Description of Artificial Sequence: Chemically synthesized oligonucleotide
cagtccagcccccaagcgg

SEQ ID NO: 5506 - DNA, 19 bp, Artificial Sequence
  Description of Artificial Sequence: Chemically synthesized oligonucleotide
ccgcttgggggctggactg

SEQ ID NO: 5507 - DNA, 19 bp, Artificial Sequence
  Description of Artificial Sequence: Chemically synthesized oligonucleotide
agtccagcccccaagcggc

SEQ ID NO: 5508 - DNA, 19 bp, Artificial Sequence
  Description of Artificial Sequence: Chemically synthesized oligonucleotide
gccgcttgggggctggact

SEQ ID NO: 5509 - DNA, 19 bp, Artificial Sequence
  Description of Artificial Sequence: Chemically synthesized oligonucleotide
gtccagcccccaagcggcc

SEQ ID NO: 5510 - DNA, 19 bp, Artificial Sequence
  Description of Artificial Sequence: Chemically synthesized oligonucleotide
ggccgcttgggggctggac

SEQ ID NO: 5511 - DNA, 19 bp, Artificial Sequence
  Description of Artificial Sequence: Chemically synthesized oligonucleotide
tccagcccccaagcggcca

SEQ ID NO: 5512 - DNA, 19 bp, Artificial Sequence
  Description of Artificial Sequence: Chemically synthesized oligonucleotide
tggccgcttgggggctgga

SEQ ID NO: 5513 - DNA, 19 bp, Artificial Sequence
  Description of Artificial Sequence: Chemically synthesized oligonucleotide
ccagcccccaagcggccac

SEQ ID NO: 5514 - DNA, 19 bp, Artificial Sequence
  Description of Artificial Sequence: Chemically synthesized oligonucleotide
gtggccgcttgggggctgg

SEQ ID NO: 5515 - DNA, 19 bp, Artificial Sequence
  Description of Artificial Sequence: Chemically synthesized oligonucleotide
cagcccccaagcggccacc

SEQ ID NO: 5516 - DNA, 19 bp, Artificial Sequence
  Description of Artificial Sequence: Chemically synthesized oligonucleotide
ggtggccgcttgggggctg

SEQ ID NO: 5517 - DNA, 19 bp, Artificial Sequence
  Description of Artificial Sequence: Chemically synthesized oligonucleotide
agcccccaagcggccaccg

SEQ ID NO: 5518 - DNA, 19 bp, Artificial Sequence
  Description of Artificial Sequence: Chemically synthesized oligonucleotide
cggtggccgcttgggggct

SEQ ID NO: 5519 - DNA, 19 bp, Artificial Sequence
  Description of Artificial Sequence: Chemically synthesized oligonucleotide
gcccccaagcggccaccgg

SEQ ID NO: 5520 - DNA, 19 bp, Artificial Sequence
  Description of Artificial Sequence: Chemically synthesized oligonucleotide
ccggtggccgcttgggggc

SEQ ID NO: 5521 - DNA, 19 bp, Artificial Sequence
  Description of Artificial Sequence: Chemically synthesized oligonucleotide
cccccaagcggccaccgga

SEQ ID NO: 5522 - DNA, 19 bp, Artificial Sequence
  Description of Artificial Sequence: Chemically synthesized oligonucleotide
tccggtggccgcttggggg

SEQ ID NO: 5523 - DNA, 19 bp, Artificial Sequence
  Description of Artificial Sequence: Chemically synthesized oligonucleotide
ccccaagcggccaccggac

SEQ ID NO: 5524 - DNA, 19 bp, Artificial Sequence
  Description of Artificial Sequence: Chemically synthesized oligonucleotide
gtccggtggccgcttgggg

SEQ ID NO: 5525 - DNA, 19 bp, Artificial Sequence
  Description of Artificial Sequence: Chemically synthesized oligonucleotide
cccaagcggccaccggacc

SEQ ID NO: 5526 - DNA, 19 bp, Artificial Sequence
  Description of Artificial Sequence: Chemically synthesized oligonucleotide
ggtccggtggccgcttggg

SEQ ID NO: 5527 - DNA, 19 bp, Artificial Sequence
  Description of Artificial Sequence: Chemically synthesized oligonucleotide
ccaagcggccaccggaccc

SEQ ID NO: 5528 - DNA, 19 bp, Artificial Sequence
  Description of Artificial Sequence: Chemically synthesized oligonucleotide
gggtccggtggccgcttgg

SEQ ID NO: 5529 - DNA, 19 bp, Artificial Sequence
  Description of Artificial Sequence: Chemically synthesized oligonucleotide
caagcggccaccggaccct

SEQ ID NO: 5530 - DNA, 19 bp, Artificial Sequence
  Description of Artificial Sequence: Chemically synthesized oligonucleotide
agggtccggtggccgcttg

SEQ ID NO: 5531 - DNA, 19 bp, Artificial Sequence
  Description of Artificial Sequence: Chemically synthesized oligonucleotide
aagcggccaccggaccctt

SEQ ID NO: 5532 - DNA, 19 bp, Artificial Sequence
  Description of Artificial Sequence: Chemically synthesized oligonucleotide
aagggtccggtggccgctt

SEQ ID NO: 5533 - DNA, 19 bp, Artificial Sequence
  Description of Artificial Sequence: Chemically synthesized oligonucleotide
agcggccaccggacccttt

SEQ ID NO: 5534 - DNA, 19 bp, Artificial Sequence
  Description of Artificial Sequence: Chemically synthesized oligonucleotide
aaagggtccggtggccgct

SEQ ID NO: 5535 - DNA, 19 bp, Artificial Sequence
  Description of Artificial Sequence: Chemically synthesized oligonucleotide
gcggccaccggaccctttt

SEQ ID NO: 5536 - DNA, 19 bp, Artificial Sequence
  Description of Artificial Sequence: Chemically synthesized oligonucleotide
aaaagggtccggtggccgc

SEQ ID NO: 5537 - DNA, 19 bp, Artificial Sequence
  Description of Artificial Sequence: Chemically synthesized oligonucleotide
cggccaccggacccttttc

SEQ ID NO: 5538 - DNA, 19 bp, Artificial Sequence
  Description of Artificial Sequence: Chemically synthesized oligonucleotide
gaaaagggtccggtggccg

SEQ ID NO: 5539 - DNA, 19 bp, Artificial Sequence
  Description of Artificial Sequence: Chemically synthesized oligonucleotide
ggccaccggacccttttcc

SEQ ID NO: 5540 - DNA, 19 bp, Artificial Sequence
  Description of Artificial Sequence: Chemically synthesized oligonucleotide
ggaaaagggtccggtggcc

SEQ ID NO: 5541 - DNA, 19 bp, Artificial Sequence
  Description of Artificial Sequence: Chemically synthesized oligonucleotide
gccaccggacccttttcca

SEQ ID NO: 5542 - DNA, 19 bp, Artificial Sequence
  Description of Artificial Sequence: Chemically synthesized oligonucleotide
tggaaaagggtccggtggc

SEQ ID NO: 5543 - DNA, 19 bp, Artificial Sequence
  Description of Artificial Sequence: Chemically synthesized oligonucleotide
ccaccggacccttttccag

SEQ ID NO: 5544 - DNA, 19 bp, Artificial Sequence
  Description of Artificial Sequence: Chemically synthesized oligonucleotide
ctggaaaagggtccggtgg

SEQ ID NO: 5545 - DNA, 19 bp, Artificial Sequence
  Description of Artificial Sequence: Chemically synthesized oligonucleotide
caccggacccttttccagg

SEQ ID NO: 5546 - DNA, 19 bp, Artificial Sequence
  Description of Artificial Sequence: Chemically synthesized oligonucleotide
cctggaaaagggtccggtg

SEQ ID NO: 5547 - DNA, 19 bp, Artificial Sequence
  Description of Artificial Sequence: Chemically synthesized oligonucleotide
accggacccttttccaggc

SEQ ID NO: 5548 - DNA, 19 bp, Artificial Sequence
  Description of Artificial Sequence: Chemically synthesized oligonucleotide
gcctggaaaagggtccggt

SEQ ID NO: 5549 - DNA, 19 bp, Artificial Sequence
  Description of Artificial Sequence: Chemically synthesized oligonucleotide
ccggacccttttccaggca

SEQ ID NO: 5550 - DNA, 19 bp, Artificial Sequence
  Description of Artificial Sequence: Chemically synthesized oligonucleotide
tgcctggaaaagggtccgg

SEQ ID NO: 5551 - DNA, 19 bp, Artificial Sequence
  Description of Artificial Sequence: Chemically synthesized oligonucleotide
cggacccttttccaggcac

SEQ ID NO: 5552 - DNA, 19 bp, Artificial Sequence
  Description of Artificial Sequence: Chemically synthesized oligonucleotide
gtgcctggaaaagggtccg

SEQ ID NO: 5553 - DNA, 19 bp, Artificial Sequence
  Description of Artificial Sequence: Chemically synthesized oligonucleotide
ggacccttttccaggcact

SEQ ID NO: 5554 - DNA, 19 bp, Artificial Sequence
  Description of Artificial Sequence: Chemically synthesized oligonucleotide
agtgcctggaaaagggtcc

SEQ ID NO: 5555 - DNA, 19 bp, Artificial Sequence
  Description of Artificial Sequence: Chemically synthesized oligonucleotide
gacccttttccaggcactg

SEQ ID NO: 5556 - DNA, 19 bp, Artificial Sequence
  Description of Artificial Sequence: Chemically synthesized oligonucleotide
cagtgcctggaaaagggtc

SEQ ID NO: 5557 - DNA, 19 bp, Artificial Sequence
  Description of Artificial Sequence: Chemically synthesized oligonucleotide
acccttttccaggcactgc

SEQ ID NO: 5558 - DNA, 19 bp, Artificial Sequence
  Description of Artificial Sequence: Chemically synthesized oligonucleotide
gcagtgcctggaaaagggt

SEQ ID NO: 5559 - DNA, 19 bp, Artificial Sequence
  Description of Artificial Sequence: Chemically synthesized oligonucleotide
cccttttccaggcactgca

SEQ ID NO: 5560 - DNA, 19 bp, Artificial Sequence
  Description of Artificial Sequence: Chemically synthesized oligonucleotide
tgcagtgcctggaaaaggg

SEQ ID NO: 5561 - DNA, 19 bp, Artificial Sequence
  Description of Artificial Sequence: Chemically synthesized oligonucleotide
ccttttccaggcactgcag

SEQ ID NO: 5562 - DNA, 19 bp, Artificial Sequence
  Description of Artificial Sequence: Chemically synthesized oligonucleotide
ctgcagtgcctggaaaagg

SEQ ID NO: 5563 - DNA, 19 bp, Artificial Sequence
  Description of Artificial Sequence: Chemically synthesized oligonucleotide
cttttccaggcactgcaga

SEQ ID NO: 5564 - DNA, 19 bp, Artificial Sequence
  Description of Artificial Sequence: Chemically synthesized oligonucleotide
tctgcagtgcctggaaaag

SEQ ID NO: 5565 - DNA, 19 bp, Artificial Sequence
  Description of Artificial Sequence: Chemically synthesized oligonucleotide
ttttccaggcactgcagaa

SEQ ID NO: 5566 - DNA, 19 bp, Artificial Sequence
  Description of Artificial Sequence: Chemically synthesized oligonucleotide
ttctgcagtgcctggaaaa

SEQ ID NO: 5567 - DNA, 19 bp, Artificial Sequence
  Description of Artificial Sequence: Chemically synthesized oligonucleotide
tttccaggcactgcagaac

SEQ ID NO: 5568 - DNA, 19 bp, Artificial Sequence
  Description of Artificial Sequence: Chemically synthesized oligonucleotide
gttctgcagtgcctggaaa

SEQ ID NO: 5569 - DNA, 19 bp, Artificial Sequence
  Description of Artificial Sequence: Chemically synthesized oligonucleotide
ttccaggcactgcagaaca

SEQ ID NO: 5570 - DNA, 19 bp, Artificial Sequence
  Description of Artificial Sequence: Chemically synthesized oligonucleotide
tgttctgcagtgcctggaa

SEQ ID NO: 5571 - DNA, 19 bp, Artificial Sequence
  Description of Artificial Sequence: Chemically synthesized oligonucleotide
tccaggcactgcagaacag

SEQ ID NO: 5572 - DNA, 19 bp, Artificial Sequence
  Description of Artificial Sequence: Chemically synthesized oligonucleotide
ctgttctgcagtgcctgga

SEQ ID NO: 5573 - DNA, 19 bp, Artificial Sequence
  Description of Artificial Sequence: Chemically synthesized oligonucleotide
ccaggcactgcagaacagg

SEQ ID NO: 5574 - DNA, 19 bp, Artificial Sequence
  Description of Artificial Sequence: Chemically synthesized oligonucleotide
cctgttctgcagtgcctgg

SEQ ID NO: 5575 - DNA, 19 bp, Artificial Sequence
  Description of Artificial Sequence: Chemically synthesized oligonucleotide
caggcactgcagaacaggg

SEQ ID NO: 5576 - DNA, 19 bp, Artificial Sequence
  Description of Artificial Sequence: Chemically synthesized oligonucleotide
ccctgttctgcagtgcctg

SEQ ID NO: 5577 - DNA, 19 bp, Artificial Sequence
  Description of Artificial Sequence: Chemically synthesized oligonucleotide
aggcactgcagaacagggg

SEQ ID NO: 5578 - DNA, 19 bp, Artificial Sequence
  Description of Artificial Sequence: Chemically synthesized oligonucleotide
cccctgttctgcagtgcct

SEQ ID NO: 5579 - DNA, 19 bp, Artificial Sequence
  Description of Artificial Sequence: Chemically synthesized oligonucleotide
ggcactgcagaacaggggg

SEQ ID NO: 5580 - DNA, 19 bp, Artificial Sequence
  Description of Artificial Sequence: Chemically synthesized oligonucleotide
ccccctgttctgcagtgcc

SEQ ID NO: 5581 - DNA, 19 bp, Artificial Sequence
  Description of Artificial Sequence: Chemically synthesized oligonucleotide
gcactgcagaacagggggc

SEQ ID NO: 5582 - DNA, 19 bp, Artificial Sequence
  Description of Artificial Sequence: Chemically synthesized oligonucleotide
gccccctgttctgcagtgc

SEQ ID NO: 5583 - DNA, 19 bp, Artificial Sequence
  Description of Artificial Sequence: Chemically synthesized oligonucleotide
cactgcagaacagggggct

SEQ ID NO: 5584 - DNA, 19 bp, Artificial Sequence
  Description of Artificial Sequence: Chemically synthesized oligonucleotide
agccccctgttctgcagtg

SEQ ID NO: 5585 - DNA, 19 bp, Artificial Sequence
  Description of Artificial Sequence: Chemically synthesized oligonucleotide
actgcagaacagggggctg

SEQ ID NO: 5586 - DNA, 19 bp, Artificial Sequence
  Description of Artificial Sequence: Chemically synthesized oligonucleotide
cagccccctgttctgcagt

SEQ ID NO: 5587 - DNA, 19 bp, Artificial Sequence
  Description of Artificial Sequence: Chemically synthesized oligonucleotide
ctgcagaacagggggctgg

SEQ ID NO: 5588 - DNA, 19 bp, Artificial Sequence
  Description of Artificial Sequence: Chemically synthesized oligonucleotide
ccagccccctgttctgcag

SEQ ID NO: 5589 - DNA, 19 bp, Artificial Sequence
  Description of Artificial Sequence: Chemically synthesized oligonucleotide
tgcagaacagggggctggg

SEQ ID NO: 5590 - DNA, 19 bp, Artificial Sequence
  Description of Artificial Sequence: Chemically synthesized oligonucleotide
cccagccccctgttctgca

SEQ ID NO: 5591 - DNA, 19 bp, Artificial Sequence
  Description of Artificial Sequence: Chemically synthesized oligonucleotide
gcagaacagggggctgggg

SEQ ID NO: 5592 - DNA, 19 bp, Artificial Sequence
  Description of Artificial Sequence: Chemically synthesized oligonucleotide
ccccagccccctgttctgc

SEQ ID NO: 5593 - DNA, 19 bp, Artificial Sequence
  Description of Artificial Sequence: Chemically synthesized oligonucleotide
cagaacagggggctggggg

SEQ ID NO: 5594 - DNA, 19 bp, Artificial Sequence
  Description of Artificial Sequence: Chemically synthesized oligonucleotide
cccccagccccctgttctg

SEQ ID NO: 5595 - DNA, 19 bp, Artificial Sequence
  Description of Artificial Sequence: Chemically synthesized oligonucleotide
agaacagggggctgggggt

SEQ ID NO: 5596 - DNA, 19 bp, Artificial Sequence
  Description of Artificial Sequence: Chemically synthesized oligonucleotide
acccccagccccctgttct

SEQ ID NO: 5597 - DNA, 19 bp, Artificial Sequence
  Description of Artificial Sequence: Chemically synthesized oligonucleotide
gaacagggggctgggggtt

SEQ ID NO: 5598 - DNA, 19 bp, Artificial Sequence
  Description of Artificial Sequence: Chemically synthesized oligonucleotide
aacccccagccccctgttc

SEQ ID NO: 5599 - DNA, 19 bp, Artificial Sequence
  Description of Artificial Sequence: Chemically synthesized oligonucleotide
aacagggggctgggggttg

SEQ ID NO: 5600 - DNA, 19 bp, Artificial Sequence
  Description of Artificial Sequence: Chemically synthesized oligonucleotide
caacccccagccccctgtt

SEQ ID NO: 5601 - DNA, 19 bp, Artificial Sequence
  Description of Artificial Sequence: Chemically synthesized oligonucleotide
acagggggctgggggttgg

SEQ ID NO: 5602 - DNA, 19 bp, Artificial Sequence
  Description of Artificial Sequence: Chemically synthesized oligonucleotide
ccaacccccagccccctgt

SEQ ID NO: 5603 - DNA, 19 bp, Artificial Sequence
  Description of Artificial Sequence: Chemically synthesized oligonucleotide
cagggggctgggggttggc

SEQ ID NO: 5604 - DNA, 19 bp, Artificial Sequence
  Description of Artificial Sequence: Chemically synthesized oligonucleotide
gccaacccccagccccctg

SEQ ID NO: 5605 - DNA, 19 bp, Artificial Sequence
  Description of Artificial Sequence: Chemically synthesized oligonucleotide
agggggctgggggttggca

SEQ ID NO: 5606 - DNA, 19 bp, Artificial Sequence
  Description of Artificial Sequence: Chemically synthesized oligonucleotide
tgccaacccccagccccct

SEQ ID NO: 5607 - DNA, 19 bp, Artificial Sequence
  Description of Artificial Sequence: Chemically synthesized oligonucleotide
gggggctgggggttggcag

SEQ ID NO: 5608 - DNA, 19 bp, Artificial Sequence
  Description of Artificial Sequence: Chemically synthesized oligonucleotide
ctgccaacccccagccccc

SEQ ID NO: 5609 - DNA, 19 bp, Artificial Sequence
  Description of Artificial Sequence: Chemically synthesized oligonucleotide
ggggctgggggttggcagg

SEQ ID NO: 5610 - DNA, 19 bp, Artificial Sequence
  Description of Artificial Sequence: Chemically synthesized oligonucleotide
cctgccaacccccagcccc

SEQ ID NO: 5611 - DNA, 19 bp, Artificial Sequence
  Description of Artificial Sequence: Chemically synthesized oligonucleotide
gggctgggggttggcagga

SEQ ID NO: 5612 - DNA, 19 bp, Artificial Sequence
  Description of Artificial Sequence: Chemically synthesized oligonucleotide
tcctgccaacccccagccc

SEQ ID NO: 5613 - DNA, 19 bp, Artificial Sequence
  Description of Artificial Sequence: Chemically synthesized oligonucleotide
ggctgggggttggcaggag

SEQ ID NO: 5614 - DNA, 19 bp, Artificial Sequence
  Description of Artificial Sequence: Chemically synthesized oligonucleotide
ctcctgccaacccccagcc

SEQ ID NO: 5615 - DNA, 19 bp, Artificial Sequence
  Description of Artificial Sequence: Chemically synthesized oligonucleotide
gctgggggttggcaggagg

SEQ ID NO: 5616 - DNA, 19 bp, Artificial Sequence
  Description of Artificial Sequence: Chemically synthesized oligonucleotide
cctcctgccaacccccagc

SEQ ID NO: 5617 - DNA, 19 bp, Artificial Sequence
  Description of Artificial Sequence: Chemically synthesized oligonucleotide
ctgggggttggcaggaggt

SEQ ID NO: 5618 - DNA, 19 bp, Artificial Sequence
  Description of Artificial Sequence: Chemically synthesized oligonucleotide
acctcctgccaacccccag

SEQ ID NO: 5619 - DNA, 19 bp, Artificial Sequence
  Description of Artificial Sequence: Chemically synthesized oligonucleotide
tgggggttggcaggaggtg

SEQ ID NO: 5620 - DNA, 19 bp, Artificial Sequence
  Description of Artificial Sequence: Chemically synthesized oligonucleotide
cacctcctgccaaccccca

SEQ ID NO: 5621 - DNA, 19 bp, Artificial Sequence
  Description of Artificial Sequence: Chemically synthesized oligonucleotide
gggggttggcaggaggtgc

SEQ ID NO: 5622 - DNA, 19 bp, Artificial Sequence
  Description of Artificial Sequence: Chemically synthesized oligonucleotide
gcacctcctgccaaccccc

SEQ ID NO: 5623 - DNA, 19 bp, Artificial Sequence
  Description of Artificial Sequence: Chemically synthesized oligonucleotide
ggggttggcaggaggtgcg

SEQ ID NO: 5624 - DNA, 19 bp, Artificial Sequence
  Description of Artificial Sequence: Chemically synthesized oligonucleotide
cgcacctcctgccaacccc

SEQ ID NO: 5625 - DNA, 19 bp, Artificial Sequence
  Description of Artificial Sequence: Chemically synthesized oligonucleotide
gggttggcaggaggtgcgg

SEQ ID NO: 5626 - DNA, 19 bp, Artificial Sequence
  Description of Artificial Sequence: Chemically synthesized oligonucleotide
ccgcacctcctgccaaccc

SEQ ID NO: 5627 - DNA, 19 bp, Artificial Sequence
  Description of Artificial Sequence: Chemically synthesized oligonucleotide
ggttggcaggaggtgcggg

SEQ ID NO: 5628 - DNA, 19 bp, Artificial Sequence
  Description of Artificial Sequence: Chemically synthesized oligonucleotide
cccgcacctcctgccaacc

SEQ ID NO: 5629 - DNA, 19 bp, Artificial Sequence
  Description of Artificial Sequence: Chemically synthesized oligonucleotide
gttggcaggaggtgcggga

SEQ ID NO: 5630 - DNA, 19 bp, Artificial Sequence
  Description of Artificial Sequence: Chemically synthesized oligonucleotide
tcccgcacctcctgccaac

SEQ ID NO: 5631 - DNA, 19 bp, Artificial Sequence
  Description of Artificial Sequence: Chemically synthesized oligonucleotide
ttggcaggaggtgcgggac

SEQ ID NO: 5632 - DNA, 19 bp, Artificial Sequence
  Description of Artificial Sequence: Chemically synthesized oligonucleotide
gtcccgcacctcctgccaa

SEQ ID NO: 5633 - DNA, 19 bp, Artificial Sequence
  Description of Artificial Sequence: Chemically synthesized oligonucleotide
tggcaggaggtgcgggaca

SEQ ID NO: 5634 - DNA, 19 bp, Artificial Sequence
  Description of Artificial Sequence: Chemically synthesized oligonucleotide
tgtcccgcacctcctgcca

SEQ ID NO: 5635 - DNA, 19 bp, Artificial Sequence
  Description of Artificial Sequence: Chemically synthesized oligonucleotide
ggcaggaggtgcgggacac

SEQ ID NO: 5636 - DNA, 19 bp, Artificial Sequence
  Description of Artificial Sequence: Chemically synthesized oligonucleotide
gtgtcccgcacctcctgcc

SEQ ID NO: 5637 - DNA, 19 bp, Artificial Sequence
  Description of Artificial Sequence: Chemically synthesized oligonucleotide
gcaggaggtgcgggacaca

SEQ ID NO: 5638 - DNA, 19 bp, Artificial Sequence
  Description of Artificial Sequence: Chemically synthesized oligonucleotide
tgtgtcccgcacctcctgc

SEQ ID NO: 5639 - DNA, 19 bp, Artificial Sequence
  Description of Artificial Sequence: Chemically synthesized oligonucleotide
caggaggtgcgggacacat

SEQ ID NO: 5640 - DNA, 19 bp, Artificial Sequence
  Description of Artificial Sequence: Chemically synthesized oligonucleotide
atgtgtcccgcacctcctg

SEQ ID NO: 5641 - DNA, 19 bp, Artificial Sequence
  Description of Artificial Sequence: Chemically synthesized oligonucleotide
aggaggtgcgggacacatc

SEQ ID NO: 5642 - DNA, 19 bp, Artificial Sequence
  Description of Artificial Sequence: Chemically synthesized oligonucleotide
gatgtgtcccgcacctcct

SEQ ID NO: 5643 - DNA, 19 bp, Artificial Sequence
  Description of Artificial Sequence: Chemically synthesized oligonucleotide
ggaggtgcgggacacatcg

SEQ ID NO: 5644 - DNA, 19 bp, Artificial Sequence
  Description of Artificial Sequence: Chemically synthesized oligonucleotide
cgatgtgtcccgcacctcc

SEQ ID NO: 5645 - DNA, 19 bp, Artificial Sequence
  Description of Artificial Sequence: Chemically synthesized oligonucleotide
gaggtgcgggacacatcga

SEQ ID NO: 5646 - DNA, 19 bp, Artificial Sequence
  Description of Artificial Sequence: Chemically synthesized oligonucleotide
tcgatgtgtcccgcacctc

SEQ ID NO: 5647 - DNA, 19 bp, Artificial Sequence
  Description of Artificial Sequence: Chemically synthesized oligonucleotide
aggtgcgggacacatcgat

SEQ ID NO: 5648 - DNA, 19 bp, Artificial Sequence
  Description of Artificial Sequence: Chemically synthesized oligonucleotide
atcgatgtgtcccgcacct

SEQ ID NO: 5649 - DNA, 19 bp, Artificial Sequence
  Description of Artificial Sequence: Chemically synthesized oligonucleotide
ggtgcgggacacatcgata

SEQ ID NO: 5650 - DNA, 19 bp, Artificial Sequence
  Description of Artificial Sequence: Chemically synthesized oligonucleotide
tatcgatgtgtcccgcacc

SEQ ID NO: 5651 - DNA, 19 bp, Artificial Sequence
  Description of Artificial Sequence: Chemically synthesized oligonucleotide
gtgcgggacacatcgatag

SEQ ID NO: 5652 - DNA, 19 bp, Artificial Sequence
  Description of Artificial Sequence: Chemically synthesized oligonucleotide
ctatcgatgtgtcccgcac

SEQ ID NO: 5653 - DNA, 19 bp, Artificial Sequence
  Description of Artificial Sequence: Chemically synthesized oligonucleotide
tgcgggacacatcgatagg

SEQ ID NO: 5654 - DNA, 19 bp, Artificial Sequence
  Description of Artificial Sequence: Chemically synthesized oligonucleotide
cctatcgatgtgtcccgca

SEQ ID NO: 5655 - DNA, 19 bp, Artificial Sequence
  Description of Artificial Sequence: Chemically synthesized oligonucleotide
gcgggacacatcgataggg

SEQ ID NO: 5656 - DNA, 19 bp, Artificial Sequence
  Description of Artificial Sequence: Chemically synthesized oligonucleotide
ccctatcgatgtgtcccgc

SEQ ID NO: 5657 - DNA, 19 bp, Artificial Sequence
  Description of Artificial Sequence: Chemically synthesized oligonucleotide
cgggacacatcgataggga

SEQ ID NO: 5658 - DNA, 19 bp, Artificial Sequence
  Description of Artificial Sequence: Chemically synthesized oligonucleotide
tccctatcgatgtgtcccg

SEQ ID NO: 5659 - DNA, 19 bp, Artificial Sequence
  Description of Artificial Sequence: Chemically synthesized oligonucleotide
gggacacatcgatagggaa

SEQ ID NO: 5660 - DNA, 19 bp, Artificial Sequence
  Description of Artificial Sequence: Chemically synthesized oligonucleotide
ttccctatcgatgtgtccc

SEQ ID NO: 5661 - DNA, 19 bp, Artificial Sequence
  Description of Artificial Sequence: Chemically synthesized oligonucleotide
ggacacatcgatagggaac

SEQ ID NO: 5662 - DNA, 19 bp, Artificial Sequence
  Description of Artificial Sequence: Chemically synthesized oligonucleotide
gttccctatcgatgtgtcc

SEQ ID NO: 5663 - DNA, 19 bp, Artificial Sequence
  Description of Artificial Sequence: Chemically synthesized oligonucleotide
gacacatcgatagggaaca

SEQ ID NO: 5664 - DNA, 19 bp, Artificial Sequence
  Description of Artificial Sequence: Chemically synthesized oligonucleotide
tgttccctatcgatgtgtc

SEQ ID NO: 5665 - DNA, 19 bp, Artificial Sequence
  Description of Artificial Sequence: Chemically synthesized oligonucleotide
acacatcgatagggaacaa

SEQ ID NO: 5666 - DNA, 19 bp, Artificial Sequence
  Description of Artificial Sequence: Chemically synthesized oligonucleotide
ttgttccctatcgatgtgt

SEQ ID NO: 5667 - DNA, 19 bp, Artificial Sequence
  Description of Artificial Sequence: Chemically synthesized oligonucleotide
cacatcgatagggaacaag

SEQ ID NO: 5668 - DNA, 19 bp, Artificial Sequence
  Description of Artificial Sequence: Chemically synthesized oligonucleotide
cttgttccctatcgatgtg

SEQ ID NO: 5669 - DNA, 19 bp, Artificial Sequence
  Description of Artificial Sequence: Chemically synthesized oligonucleotide
acatcgatagggaacaagg

SEQ ID NO: 5670 - DNA, 19 bp, Artificial Sequence
  Description of Artificial Sequence: Chemically synthesized oligonucleotide
ccttgttccctatcgatgt

SEQ ID NO: 5671 - DNA, 19 bp, Artificial Sequence
  Description of Artificial Sequence: Chemically synthesized oligonucleotide
catcgatagggaacaagga

SEQ ID NO: 5672 - DNA, 19 bp, Artificial Sequence
  Description of Artificial Sequence: Chemically synthesized oligonucleotide
tccttgttccctatcgatg

SEQ ID NO: 5673 - DNA, 19 bp, Artificial Sequence
  Description of Artificial Sequence: Chemically synthesized oligonucleotide
atcgatagggaacaaggat

SEQ ID NO: 5674 - DNA, 19 bp, Artificial Sequence
  Description of Artificial Sequence: Chemically synthesized oligonucleotide
atccttgttccctatcgat

SEQ ID NO: 5675 - DNA, 19 bp, Artificial Sequence
  Description of Artificial Sequence: Chemically synthesized oligonucleotide
tcgatagggaacaaggatg

SEQ ID NO: 5676 - DNA, 19 bp, Artificial Sequence
  Description of Artificial Sequence: Chemically synthesized oligonucleotide
catccttgttccctatcga

SEQ ID NO: 5677 - DNA, 19 bp, Artificial Sequence
  Description of Artificial Sequence: Chemically synthesized oligonucleotide
cgatagggaacaaggatgt

SEQ ID NO: 5678 - DNA, 19 bp, Artificial Sequence
  Description of Artificial Sequence: Chemically synthesized oligonucleotide
acatccttgttccctatcg

SEQ ID NO: 5679 - DNA, 19 bp, Artificial Sequence
  Description of Artificial Sequence: Chemically synthesized oligonucleotide
gatagggaacaaggatgtg

SEQ ID NO: 5680 - DNA, 19 bp, Artificial Sequence
  Description of Artificial Sequence: Chemically synthesized oligonucleotide
cacatccttgttccctatc

SEQ ID NO: 5681 - DNA, 19 bp, Artificial Sequence
  Description of Artificial Sequence: Chemically synthesized oligonucleotide
atagggaacaaggatgtgg

SEQ ID NO: 5682 - DNA, 19 bp, Artificial Sequence
  Description of Artificial Sequence: Chemically synthesized oligonucleotide
ccacatccttgttccctat

SEQ ID NO: 5683 - DNA, 19 bp, Artificial Sequence
  Description of Artificial Sequence: Chemically synthesized oligonucleotide
tagggaacaaggatgtgga

SEQ ID NO: 5684 - DNA, 19 bp, Artificial Sequence
  Description of Artificial Sequence: Chemically synthesized oligonucleotide
tccacatccttgttcccta

SEQ ID NO: 5685 - DNA, 19 bp, Artificial Sequence
  Description of Artificial Sequence: Chemically synthesized oligonucleotide
agggaacaaggatgtggac

SEQ ID NO: 5686 - DNA, 19 bp, Artificial Sequence
  Description of Artificial Sequence: Chemically synthesized oligonucleotide
gtccacatccttgttccct

SEQ ID NO: 5687 - DNA, 19 bp, Artificial Sequence
  Description of Artificial Sequence: Chemically synthesized oligonucleotide
gggaacaaggatgtggact

SEQ ID NO: 5688 - DNA, 19 bp, Artificial Sequence
  Description of Artificial Sequence: Chemically synthesized oligonucleotide
agtccacatccttgttccc

SEQ ID NO: 5689 - DNA, 19 bp, Artificial Sequence
  Description of Artificial Sequence: Chemically synthesized oligonucleotide
ggaacaaggatgtggactc

SEQ ID NO: 5690 - DNA, 19 bp, Artificial Sequence
  Description of Artificial Sequence: Chemically synthesized oligonucleotide
gagtccacatccttgttcc

SEQ ID NO: 5691 - DNA, 19 bp, Artificial Sequence
  Description of Artificial Sequence: Chemically synthesized oligonucleotide
gaacaaggatgtggactcg

SEQ ID NO: 5692 - DNA, 19 bp, Artificial Sequence
  Description of Artificial Sequence: Chemically synthesized oligonucleotide
cgagtccacatccttgttc

SEQ ID NO: 5693 - DNA, 19 bp, Artificial Sequence
  Description of Artificial Sequence: Chemically synthesized oligonucleotide
aacaaggatgtggactcgg

SEQ ID NO: 5694 - DNA, 19 bp, Artificial Sequence
  Description of Artificial Sequence: Chemically synthesized oligonucleotide
ccgagtccacatccttgtt

SEQ ID NO: 5695 - DNA, 19 bp, Artificial Sequence
  Description of Artificial Sequence: Chemically synthesized oligonucleotide
acaaggatgtggactcggg

SEQ ID NO: 5696 - DNA, 19 bp, Artificial Sequence
  Description of Artificial Sequence: Chemically synthesized oligonucleotide
cccgagtccacatccttgt

SEQ ID NO: 5697 - DNA, 19 bp, Artificial Sequence
  Description of Artificial Sequence: Chemically synthesized oligonucleotide
caaggatgtggactcggga

SEQ ID NO: 5698 - DNA, 19 bp, Artificial Sequence
  Description of Artificial Sequence: Chemically synthesized oligonucleotide
tcccgagtccacatccttg

SEQ ID NO: 5699 - DNA, 19 bp, Artificial Sequence
  Description of Artificial Sequence: Chemically synthesized oligonucleotide
aaggatgtggactcgggac

SEQ ID NO: 5700 - DNA, 19 bp, Artificial Sequence
  Description of Artificial Sequence: Chemically synthesized oligonucleotide
gtcccgagtccacatcctt

SEQ ID NO: 5701 - DNA, 19 bp, Artificial Sequence
  Description of Artificial Sequence: Chemically synthesized oligonucleotide
aggatgtggactcgggaca

SEQ ID NO: 5702 - DNA, 19 bp, Artificial Sequence
  Description of Artificial Sequence: Chemically synthesized oligonucleotide
tgtcccgagtccacatcct

SEQ ID NO: 5703 - DNA, 19 bp, Artificial Sequence
  Description of Artificial Sequence: Chemically synthesized oligonucleotide
ggatgtggactcgggacag

SEQ ID NO: 5704 - DNA, 19 bp, Artificial Sequence
  Description of Artificial Sequence: Chemically synthesized oligonucleotide
ctgtcccgagtccacatcc

SEQ ID NO: 5705 - DNA, 19 bp, Artificial Sequence
  Description of Artificial Sequence: Chemically synthesized oligonucleotide
gatgtggactcgggacagc

SEQ ID NO: 5706 - DNA, 19 bp, Artificial Sequence
  Description of Artificial Sequence: Chemically synthesized oligonucleotide
gctgtcccgagtccacatc

SEQ ID NO: 5707 - DNA, 19 bp, Artificial Sequence
  Description of Artificial Sequence: Chemically synthesized oligonucleotide
atgtggactcgggacagca

SEQ ID NO: 5708 - DNA, 19 bp, Artificial Sequence
  Description of Artificial Sequence: Chemically synthesized oligonucleotide
tgctgtcccgagtccacat

SEQ ID NO: 5709 - DNA, 19 bp, Artificial Sequence
  Description of Artificial Sequence: Chemically synthesized oligonucleotide
tgtggactcgggacagcat

SEQ ID NO: 5710 - DNA, 19 bp, Artificial Sequence
  Description of Artificial Sequence: Chemically synthesized oligonucleotide
atgctgtcccgagtccaca

SEQ ID NO: 5711 - DNA, 19 bp, Artificial Sequence
  Description of Artificial Sequence: Chemically synthesized oligonucleotide
gtggactcgggacagcatg

SEQ ID NO: 5712 - DNA, 19 bp, Artificial Sequence
  Description of Artificial Sequence: Chemically synthesized oligonucleotide
catgctgtcccgagtccac

SEQ ID NO: 5713 - DNA, 19 bp, Artificial Sequence
  Description of Artificial Sequence: Chemically synthesized oligonucleotide
tggactcgggacagcatga

SEQ ID NO: 5714 - DNA, 19 bp, Artificial Sequence
  Description of Artificial Sequence: Chemically synthesized oligonucleotide
tcatgctgtcccgagtcca

SEQ ID NO: 5715 - DNA, 19 bp, Artificial Sequence
  Description of Artificial Sequence: Chemically synthesized oligonucleotide
ggactcgggacagcatgat

SEQ ID NO: 5716 - DNA, 19 bp, Artificial Sequence
  Description of Artificial Sequence: Chemically synthesized oligonucleotide
atcatgctgtcccgagtcc

SEQ ID NO: 5717 - DNA, 19 bp, Artificial Sequence
  Description of Artificial Sequence: Chemically synthesized oligonucleotide
gactcgggacagcatgatg

SEQ ID NO: 5718 - DNA, 19 bp, Artificial Sequence
  Description of Artificial Sequence: Chemically synthesized oligonucleotide
catcatgctgtcccgagtc

SEQ ID NO: 5719 - DNA, 19 bp, Artificial Sequence
  Description of Artificial Sequence: Chemically synthesized oligonucleotide
actcgggacagcatgatga

SEQ ID NO: 5720 - DNA, 19 bp, Artificial Sequence
  Description of Artificial Sequence: Chemically synthesized oligonucleotide
tcatcatgctgtcccgagt

SEQ ID NO: 5721 - DNA, 19 bp, Artificial Sequence
  Description of Artificial Sequence: Chemically synthesized oligonucleotide
ctcgggacagcatgatgag

SEQ ID NO: 5722 - DNA, 19 bp, Artificial Sequence
  Description of Artificial Sequence: Chemically synthesized oligonucleotide
ctcatcatgctgtcccgag

SEQ ID NO: 5723 - DNA, 19 bp, Artificial Sequence
  Description of Artificial Sequence: Chemically synthesized oligonucleotide
tcgggacagcatgatgagc

SEQ ID NO: 5724 - DNA, 19 bp, Artificial Sequence
  Description of Artificial Sequence: Chemically synthesized oligonucleotide
gctcatcatgctgtcccga

SEQ ID NO: 5725 - DNA, 19 bp, Artificial Sequence
  Description of Artificial Sequence: Chemically synthesized oligonucleotide
cgggacagcatgatgagca

SEQ ID NO: 5726 - DNA, 19 bp, Artificial Sequence
  Description of Artificial Sequence: Chemically synthesized oligonucleotide
tgctcatcatgctgtcccg

SEQ ID NO: 5727 - DNA, 19 bp, Artificial Sequence
  Description of Artificial Sequence: Chemically synthesized oligonucleotide
gggacagcatgatgagcag

SEQ ID NO: 5728 - DNA, 19 bp, Artificial Sequence
  Description of Artificial Sequence: Chemically synthesized oligonucleotide
ctgctcatcatgctgtccc

SEQ ID NO: 5729 - DNA, 19 bp, Artificial Sequence
  Description of Artificial Sequence: Chemically synthesized oligonucleotide
ggacagcatgatgagcaga

SEQ ID NO: 5730 - DNA, 19 bp, Artificial Sequence
  Description of Artificial Sequence: Chemically synthesized oligonucleotide
tctgctcatcatgctgtcc

SEQ ID NO: 5731 - DNA, 19 bp, Artificial Sequence
  Description of Artificial Sequence: Chemically synthesized oligonucleotide
gacagcatgatgagcagaa

SEQ ID NO: 5732 - DNA, 19 bp, Artificial Sequence
  Description of Artificial Sequence: Chemically synthesized oligonucleotide
ttctgctcatcatgctgtc

SEQ ID NO: 5733 - DNA, 19 bp, Artificial Sequence
  Description of Artificial Sequence: Chemically synthesized oligonucleotide
acagcatgatgagcagaaa

SEQ ID NO: 5734 - DNA, 19 bp, Artificial Sequence
  Description of Artificial Sequence: Chemically synthesized oligonucleotide
tttctgctcatcatgctgt

SEQ ID NO: 5735 - DNA, 19 bp, Artificial Sequence
  Description of Artificial Sequence: Chemically synthesized oligonucleotide
cagcatgatgagcagaaag

SEQ ID NO: 5736 - DNA, 19 bp, Artificial Sequence
  Description of Artificial Sequence: Chemically synthesized oligonucleotide
ctttctgctcatcatgctg

SEQ ID NO: 5737 - DNA, 19 bp, Artificial Sequence
  Description of Artificial Sequence: Chemically synthesized oligonucleotide
agcatgatgagcagaaagg

SEQ ID NO: 5738 - DNA, 19 bp, Artificial Sequence
  Description of Artificial Sequence: Chemically synthesized oligonucleotide
cctttctgctcatcatgct

SEQ ID NO: 5739 - DNA, 19 bp, Artificial Sequence
  Description of Artificial Sequence: Chemically synthesized oligonucleotide
gcatgatgagcagaaagga

SEQ ID NO: 5740 - DNA, 19 bp, Artificial Sequence
  Description of Artificial Sequence: Chemically synthesized oligonucleotide
tcctttctgctcatcatgc

SEQ ID NO: 5741 - DNA, 19 bp, Artificial Sequence
  Description of Artificial Sequence: Chemically synthesized oligonucleotide
catgatgagcagaaaggac

SEQ ID NO: 5742 - DNA, 19 bp, Artificial Sequence
  Description of Artificial Sequence: Chemically synthesized oligonucleotide
gtcctttctgctcatcatg

SEQ ID NO: 5743 - DNA, 19 bp, Artificial Sequence
  Description of Artificial Sequence: Chemically synthesized oligonucleotide
atgatgagcagaaaggacc

SEQ ID NO: 5744 - DNA, 19 bp, Artificial Sequence
  Description of Artificial Sequence: Chemically synthesized oligonucleotide
ggtcctttctgctcatcat

SEQ ID NO: 5745 - DNA, 19 bp, Artificial Sequence
  Description of Artificial Sequence: Chemically synthesized oligonucleotide
tgatgagcagaaaggaccc

SEQ ID NO: 5746 - DNA, 19 bp, Artificial Sequence
  Description of Artificial Sequence: Chemically synthesized oligonucleotide
gggtcctttctgctcatca

SEQ ID NO: 5747 - DNA, 19 bp, Artificial Sequence
  Description of Artificial Sequence: Chemically synthesized oligonucleotide
gatgagcagaaaggacccc

SEQ ID NO: 5748 - DNA, 19 bp, Artificial Sequence
  Description of Artificial Sequence: Chemically synthesized oligonucleotide
ggggtcctttctgctcatc

SEQ ID NO: 5749 - DNA, 19 bp, Artificial Sequence
  Description of Artificial Sequence: Chemically synthesized oligonucleotide
atgagcagaaaggacccca

SEQ ID NO: 5750 - DNA, 19 bp, Artificial Sequence
  Description of Artificial Sequence: Chemically synthesized oligonucleotide
tggggtcctttctgctcat

SEQ ID NO: 5751 - DNA, 19 bp, Artificial Sequence
  Description of Artificial Sequence: Chemically synthesized oligonucleotide
tgagcagaaaggaccccaa

SEQ ID NO: 5752 - DNA, 19 bp, Artificial Sequence
  Description of Artificial Sequence: Chemically synthesized oligonucleotide
ttggggtcctttctgctca

SEQ ID NO: 5753 - DNA, 19 bp, Artificial Sequence
  Description of Artificial Sequence: Chemically synthesized oligonucleotide
gagcagaaaggaccccaag

SEQ ID NO: 5754 - DNA, 19 bp, Artificial Sequence
  Description of Artificial Sequence: Chemically synthesized oligonucleotide
cttggggtcctttctgctc

SEQ ID NO: 5755 - DNA, 19 bp, Artificial Sequence
  Description of Artificial Sequence: Chemically synthesized oligonucleotide
agcagaaaggaccccaaga

SEQ ID NO: 5756 - DNA, 19 bp, Artificial Sequence
  Description of Artificial Sequence: Chemically synthesized oligonucleotide
tcttggggtcctttctgct

SEQ ID NO: 5757 - DNA, 19 bp, Artificial Sequence
  Description of Artificial Sequence: Chemically synthesized oligonucleotide
gcagaaaggaccccaagat

SEQ ID NO: 5758 - DNA, 19 bp, Artificial Sequence
  Description of Artificial Sequence: Chemically synthesized oligonucleotide
atcttggggtcctttctgc

SEQ ID NO: 5759 - DNA, 19 bp, Artificial Sequence
  Description of Artificial Sequence: Chemically synthesized oligonucleotide
cagaaaggaccccaagatg

SEQ ID NO: 5760 - DNA, 19 bp, Artificial Sequence
  Description of Artificial Sequence: Chemically synthesized oligonucleotide
catcttggggtcctttctg

SEQ ID NO: 5761 - DNA, 19 bp, Artificial Sequence
  Description of Artificial Sequence: Chemically synthesized oligonucleotide
agaaaggaccccaagatgg

SEQ ID NO: 5762 - DNA, 19 bp, Artificial Sequence
  Description of Artificial Sequence: Chemically synthesized oligonucleotide
ccatcttggggtcctttct

SEQ ID NO: 5763 - DNA, 19 bp, Artificial Sequence
  Description of Artificial Sequence: Chemically synthesized oligonucleotide
gaaaggaccccaagatggc

SEQ ID NO: 5764 - DNA, 19 bp, Artificial Sequence
  Description of Artificial Sequence: Chemically synthesized oligonucleotide
gccatcttggggtcctttc

SEQ ID NO: 5765 - DNA, 19 bp, Artificial Sequence
  Description of Artificial Sequence: Chemically synthesized oligonucleotide
aaaggaccccaagatggcc

SEQ ID NO: 5766 - DNA, 19 bp, Artificial Sequence
  Description of Artificial Sequence: Chemically synthesized oligonucleotide
ggccatcttggggtccttt

SEQ ID NO: 5767 - DNA, 19 bp, Artificial Sequence
  Description of Artificial Sequence: Chemically synthesized oligonucleotide
aaggaccccaagatggcca

SEQ ID NO: 5768 - DNA, 19 bp, Artificial Sequence
  Description of Artificial Sequence: Chemically synthesized oligonucleotide
tggccatcttggggtcctt

SEQ ID NO: 5769 - DNA, 19 bp, Artificial Sequence
  Description of Artificial Sequence: Chemically synthesized oligonucleotide
aggaccccaagatggccag

SEQ ID NO: 5770 - DNA, 19 bp, Artificial Sequence
  Description of Artificial Sequence: Chemically synthesized oligonucleotide
ctggccatcttggggtcct

SEQ ID NO: 5771 - DNA, 19 bp, Artificial Sequence
  Description of Artificial Sequence: Chemically synthesized oligonucleotide
ggaccccaagatggccagg

SEQ ID NO: 5772 - DNA, 19 bp, Artificial Sequence
  Description of Artificial Sequence: Chemically synthesized oligonucleotide
cctggccatcttggggtcc

SEQ ID NO: 5773 - DNA, 19 bp, Artificial Sequence
  Description of Artificial Sequence: Chemically synthesized oligonucleotide
gaccccaagatggccaggc

SEQ ID NO: 5774 - DNA, 19 bp, Artificial Sequence
  Description of Artificial Sequence: Chemically synthesized oligonucleotide
gcctggccatcttggggtc

SEQ ID NO: 5775 - DNA, 19 bp, Artificial Sequence
  Description of Artificial Sequence: Chemically synthesized oligonucleotide
accccaagatggccaggcc

SEQ ID NO: 5776 - DNA, 19 bp, Artificial Sequence
  Description of Artificial Sequence: Chemically synthesized oligonucleotide
ggcctggccatcttggggt

SEQ ID NO: 5777 - DNA, 19 bp, Artificial Sequence
  Description of Artificial Sequence: Chemically synthesized oligonucleotide
ccccaagatggccaggcca

SEQ ID NO: 5778 - DNA, 19 bp, Artificial Sequence
  Description of Artificial Sequence: Chemically synthesized oligonucleotide
tggcctggccatcttgggg

SEQ ID NO: 5779 - DNA, 19 bp, Artificial Sequence
  Description of Artificial Sequence: Chemically synthesized oligonucleotide
cccaagatggccaggccag

SEQ ID NO: 5780 - DNA, 19 bp, Artificial Sequence
  Description of Artificial Sequence: Chemically synthesized oligonucleotide
ctggcctggccatcttggg

SEQ ID NO: 5781 - DNA, 19 bp, Artificial Sequence
  Description of Artificial Sequence: Chemically synthesized oligonucleotide
ccaagatggccaggccagt

SEQ ID NO: 5782 - DNA, 19 bp, Artificial Sequence
  Description of Artificial Sequence: Chemically synthesized oligonucleotide
actggcctggccatcttgg

SEQ ID NO: 5783 - DNA, 19 bp, Artificial Sequence
  Description of Artificial Sequence: Chemically synthesized oligonucleotide
caagatggccaggccagtc

SEQ ID NO: 5784 - DNA, 19 bp, Artificial Sequence
  Description of Artificial Sequence: Chemically synthesized oligonucleotide
gactggcctggccatcttg

SEQ ID NO: 5785 - DNA, 19 bp, Artificial Sequence
  Description of Artificial Sequence: Chemically synthesized oligonucleotide
aagatggccaggccagtct

SEQ ID NO: 5786 - DNA, 19 bp, Artificial Sequence
  Description of Artificial Sequence: Chemically synthesized oligonucleotide
agactggcctggccatctt

SEQ ID NO: 5787 - DNA, 19 bp, Artificial Sequence
  Description of Artificial Sequence: Chemically synthesized oligonucleotide
agatggccaggccagtctc

SEQ ID NO: 5788 - DNA, 19 bp, Artificial Sequence
  Description of Artificial Sequence: Chemically synthesized oligonucleotide
gagactggcctggccatct

SEQ ID NO: 5789 - DNA, 19 bp, Artificial Sequence
  Description of Artificial Sequence: Chemically synthesized oligonucleotide
gatggccaggccagtctcc

SEQ ID NO: 5790 - DNA, 19 bp, Artificial Sequence
  Description of Artificial Sequence: Chemically synthesized oligonucleotide
ggagactggcctggccatc

SEQ ID NO: 5791 - DNA, 19 bp, Artificial Sequence
  Description of Artificial Sequence: Chemically synthesized oligonucleotide
atggccaggccagtctcca

SEQ ID NO: 5792 - DNA, 19 bp, Artificial Sequence
  Description of Artificial Sequence: Chemically synthesized oligonucleotide
tggagactggcctggccat

SEQ ID NO: 5793 - DNA, 19 bp, Artificial Sequence
  Description of Artificial Sequence: Chemically synthesized oligonucleotide
tggccaggccagtctccag

SEQ ID NO: 5794 - DNA, 19 bp, Artificial Sequence
  Description of Artificial Sequence: Chemically synthesized oligonucleotide
ctggagactggcctggcca

SEQ ID NO: 5795 - DNA, 19 bp, Artificial Sequence
  Description of Artificial Sequence: Chemically synthesized oligonucleotide
ggccaggccagtctccagg

SEQ ID NO: 5796 - DNA, 19 bp, Artificial Sequence
  Description of Artificial Sequence: Chemically synthesized oligonucleotide
cctggagactggcctggcc

SEQ ID NO: 5797 - DNA, 19 bp, Artificial Sequence
  Description of Artificial Sequence: Chemically synthesized oligonucleotide
gccaggccagtctccagga

SEQ ID NO: 5798 - DNA, 19 bp, Artificial Sequence
  Description of Artificial Sequence: Chemically synthesized oligonucleotide
tcctggagactggcctggc

SEQ ID NO: 5799 - DNA, 19 bp, Artificial Sequence
  Description of Artificial Sequence: Chemically synthesized oligonucleotide
ccaggccagtctccaggac

SEQ ID NO: 5800 - DNA, 19 bp, Artificial Sequence
  Description of Artificial Sequence: Chemically synthesized oligonucleotide
gtcctggagactggcctgg

SEQ ID NO: 5801 - DNA, 19 bp, Artificial Sequence
  Description of Artificial Sequence: Chemically synthesized oligonucleotide
caggccagtctccaggacc

SEQ ID NO: 5802 - DNA, 19 bp, Artificial Sequence
  Description of Artificial Sequence: Chemically synthesized oligonucleotide
ggtcctggagactggcctg

SEQ ID NO: 5803 - DNA, 19 bp, Artificial Sequence
  Description of Artificial Sequence: Chemically synthesized oligonucleotide
aggccagtctccaggaccc

SEQ ID NO: 5804 - DNA, 19 bp, Artificial Sequence
  Description of Artificial Sequence: Chemically synthesized oligonucleotide
gggtcctggagactggcct

SEQ ID NO: 5805 - DNA, 19 bp, Artificial Sequence
  Description of Artificial Sequence: Chemically synthesized oligonucleotide
ggccagtctccaggacccg

SEQ ID NO: 5806 - DNA, 19 bp, Artificial Sequence
  Description of Artificial Sequence: Chemically synthesized oligonucleotide
cgggtcctggagactggcc

SEQ ID NO: 5807 - DNA, 19 bp, Artificial Sequence
  Description of Artificial Sequence: Chemically synthesized oligonucleotide
gccagtctccaggacccgg

SEQ ID NO: 5808 - DNA, 19 bp, Artificial Sequence
  Description of Artificial Sequence: Chemically synthesized oligonucleotide
ccgggtcctggagactggc

SEQ ID NO: 5809 - DNA, 19 bp, Artificial Sequence
  Description of Artificial Sequence: Chemically synthesized oligonucleotide
ccagtctccaggacccggg

SEQ ID NO: 5810 - DNA, 19 bp, Artificial Sequence
  Description of Artificial Sequence: Chemically synthesized oligonucleotide
cccgggtcctggagactgg

SEQ ID NO: 5811 - DNA, 19 bp, Artificial Sequence
  Description of Artificial Sequence: Chemically synthesized oligonucleotide
cagtctccaggacccggga

SEQ ID NO: 5812 - DNA, 19 bp, Artificial Sequence
  Description of Artificial Sequence: Chemically synthesized oligonucleotide
tcccgggtcctggagactg

SEQ ID NO: 5813 - DNA, 19 bp, Artificial Sequence
  Description of Artificial Sequence: Chemically synthesized oligonucleotide
agtctccaggacccgggac

SEQ ID NO: 5814 - DNA, 19 bp, Artificial Sequence
  Description of Artificial Sequence: Chemically synthesized oligonucleotide
gtcccgggtcctggagact

SEQ ID NO: 5815 - DNA, 19 bp, Artificial Sequence
  Description of Artificial Sequence: Chemically synthesized oligonucleotide
gtctccaggacccgggact

SEQ ID NO: 5816 - DNA, 19 bp, Artificial Sequence
  Description of Artificial Sequence: Chemically synthesized oligonucleotide
agtcccgggtcctggagac

SEQ ID NO: 5817 - DNA, 19 bp, Artificial Sequence
  Description of Artificial Sequence: Chemically synthesized oligonucleotide
tctccaggacccgggactt

SEQ ID NO: 5818 - DNA, 19 bp, Artificial Sequence
  Description of Artificial Sequence: Chemically synthesized oligonucleotide
aagtcccgggtcctggaga

SEQ ID NO: 5819 - DNA, 19 bp, Artificial Sequence
  Description of Artificial Sequence: Chemically synthesized oligonucleotide
ctccaggacccgggacttc

SEQ ID NO: 5820 - DNA, 19 bp, Artificial Sequence
  Description of Artificial Sequence: Chemically synthesized oligonucleotide
gaagtcccgggtcctggag

SEQ ID NO: 5821 - DNA, 19 bp, Artificial Sequence
  Description of Artificial Sequence: Chemically synthesized oligonucleotide
tccaggacccgggacttca

SEQ ID NO: 5822 - DNA, 19 bp, Artificial Sequence
  Description of Artificial Sequence: Chemically synthesized oligonucleotide
tgaagtcccgggtcctgga

SEQ ID NO: 5823 - DNA, 19 bp, Artificial Sequence
  Description of Artificial Sequence: Chemically synthesized oligonucleotide
ccaggacccgggacttcag

SEQ ID NO: 5824 - DNA, 19 bp, Artificial Sequence
  Description of Artificial Sequence: Chemically synthesized oligonucleotide
ctgaagtcccgggtcctgg

SEQ ID NO: 5825 - DNA, 19 bp, Artificial Sequence
  Description of Artificial Sequence: Chemically synthesized oligonucleotide
caggacccgggacttcagg

SEQ ID NO: 5826 - DNA, 19 bp, Artificial Sequence
  Description of Artificial Sequence: Chemically synthesized oligonucleotide
cctgaagtcccgggtcctg

SEQ ID NO: 5827 - DNA, 19 bp, Artificial Sequence
  Description of Artificial Sequence: Chemically synthesized oligonucleotide
aggacccgggacttcagga

SEQ ID NO: 5828 - DNA, 19 bp, Artificial Sequence
  Description of Artificial Sequence: Chemically synthesized oligonucleotide
tcctgaagtcccgggtcct

SEQ ID NO: 5829 - DNA, 19 bp, Artificial Sequence
  Description of Artificial Sequence: Chemically synthesized oligonucleotide
ggacccgggacttcaggac

SEQ ID NO: 5830 - DNA, 19 bp, Artificial Sequence
  Description of Artificial Sequence: Chemically synthesized oligonucleotide
gtcctgaagtcccgggtcc

SEQ ID NO: 5831 - DNA, 19 bp, Artificial Sequence
  Description of Artificial Sequence: Chemically synthesized oligonucleotide
gacccgggacttcaggaca

SEQ ID NO: 5832 - DNA, 19 bp, Artificial Sequence
  Description of Artificial Sequence: Chemically synthesized oligonucleotide
tgtcctgaagtcccgggtc

SEQ ID NO: 5833 - DNA, 19 bp, Artificial Sequence
  Description of Artificial Sequence: Chemically synthesized oligonucleotide
acccgggacttcaggacat

SEQ ID NO: 5834 - DNA, 19 bp, Artificial Sequence
  Description of Artificial Sequence: Chemically synthesized oligonucleotide
atgtcctgaagtcccgggt

SEQ ID NO: 5835 - DNA, 19 bp, Artificial Sequence
  Description of Artificial Sequence: Chemically synthesized oligonucleotide
cccgggacttcaggacata

SEQ ID NO: 5836 - DNA, 19 bp, Artificial Sequence
  Description of Artificial Sequence: Chemically synthesized oligonucleotide
tatgtcctgaagtcccggg

SEQ ID NO: 5837 - DNA, 19 bp, Artificial Sequence
  Description of Artificial Sequence: Chemically synthesized oligonucleotide
ccgggacttcaggacatac

SEQ ID NO: 5838 - DNA, 19 bp, Artificial Sequence
  Description of Artificial Sequence: Chemically synthesized oligonucleotide
gtatgtcctgaagtcccgg

SEQ ID NO: 5839 - DNA, 19 bp, Artificial Sequence
  Description of Artificial Sequence: Chemically synthesized oligonucleotide
cgggacttcaggacatacc

SEQ ID NO: 5840 - DNA, 19 bp, Artificial Sequence
  Description of Artificial Sequence: Chemically synthesized oligonucleotide
ggtatgtcctgaagtcccg

SEQ ID NO: 5841 - DNA, 19 bp, Artificial Sequence
  Description of Artificial Sequence: Chemically synthesized oligonucleotide
gggacttcaggacatacca

SEQ ID NO: 5842 - DNA, 19 bp, Artificial Sequence
  Description of Artificial Sequence: Chemically synthesized oligonucleotide
tggtatgtcctgaagtccc

SEQ ID NO: 5843 - DNA, 19 bp, Artificial Sequence
  Description of Artificial Sequence: Chemically synthesized oligonucleotide
ggacttcaggacataccat

SEQ ID NO: 5844 - DNA, 19 bp, Artificial Sequence
  Description of Artificial Sequence: Chemically synthesized oligonucleotide
atggtatgtcctgaagtcc

SEQ ID NO: 5845 - DNA, 19 bp, Artificial Sequence
  Description of Artificial Sequence: Chemically synthesized oligonucleotide
gacttcaggacataccatg

SEQ ID NO: 5846 - DNA, 19 bp, Artificial Sequence
  Description of Artificial Sequence: Chemically synthesized oligonucleotide
catggtatgtcctgaagtc

SEQ ID NO: 5847 - DNA, 19 bp, Artificial Sequence
  Description of Artificial Sequence: Chemically synthesized oligonucleotide
acttcaggacataccatgc

SEQ ID NO: 5848 - DNA, 19 bp, Artificial Sequence
  Description of Artificial Sequence: Chemically synthesized oligonucleotide
gcatggtatgtcctgaagt

SEQ ID NO: 5849 - DNA, 19 bp, Artificial Sequence
  Description of Artificial Sequence: Chemically synthesized oligonucleotide
cttcaggacataccatgcc

SEQ ID NO: 5850 - DNA, 19 bp, Artificial Sequence
  Description of Artificial Sequence: Chemically synthesized oligonucleotide
ggcatggtatgtcctgaag

SEQ ID NO: 5851 - DNA, 19 bp, Artificial Sequence
  Description of Artificial Sequence: Chemically synthesized oligonucleotide
ttcaggacataccatgcct

SEQ ID NO: 5852 - DNA, 19 bp, Artificial Sequence
  Description of Artificial Sequence: Chemically synthesized oligonucleotide
aggcatggtatgtcctgaa

SEQ ID NO: 5853 - DNA, 19 bp, Artificial Sequence
  Description of Artificial Sequence: Chemically synthesized oligonucleotide
tcaggacataccatgcctg

SEQ ID NO: 5854 - DNA, 19 bp, Artificial Sequence
  Description of Artificial Sequence: Chemically synthesized oligonucleotide
caggcatggtatgtcctga

SEQ ID NO: 5855 - DNA, 19 bp, Artificial Sequence
  Description of Artificial Sequence: Chemically synthesized oligonucleotide
caggacataccatgcctgg

SEQ ID NO: 5856 - DNA, 19 bp, Artificial Sequence
  Description of Artificial Sequence: Chemically synthesized oligonucleotide
ccaggcatggtatgtcctg

SEQ ID NO: 5857 - DNA, 19 bp, Artificial Sequence
  Description of Artificial Sequence: Chemically synthesized oligonucleotide
aggacataccatgcctggc

SEQ ID NO: 5858 - DNA, 19 bp, Artificial Sequence
  Description of Artificial Sequence: Chemically synthesized oligonucleotide
gccaggcatggtatgtcct

SEQ ID NO: 5859 - DNA, 19 bp, Artificial Sequence
  Description of Artificial Sequence: Chemically synthesized oligonucleotide
ggacataccatgcctggct

SEQ ID NO: 5860 - DNA, 19 bp, Artificial Sequence
  Description of Artificial Sequence: Chemically synthesized oligonucleotide
agccaggcatggtatgtcc

SEQ ID NO: 5861 - DNA, 19 bp, Artificial Sequence
  Description of Artificial Sequence: Chemically synthesized oligonucleotide
gacataccatgcctggctc

SEQ ID NO: 5862 - DNA, 19 bp, Artificial Sequence
  Description of Artificial Sequence: Chemically synthesized oligonucleotide
gagccaggcatggtatgtc

SEQ ID NO: 5863 - DNA, 19 bp, Artificial Sequence
  Description of Artificial Sequence: Chemically synthesized oligonucleotide
acataccatgcctggctct

SEQ ID NO: 5864 - DNA, 19 bp, Artificial Sequence
  Description of Artificial Sequence: Chemically synthesized oligonucleotide
agagccaggcatggtatgt

SEQ ID NO: 5865 - DNA, 19 bp, Artificial Sequence
  Description of Artificial Sequence: Chemically synthesized oligonucleotide
cataccatgcctggctctc

SEQ ID NO: 5866 - DNA, 19 bp, Artificial Sequence
  Description of Artificial Sequence: Chemically synthesized oligonucleotide
gagagccaggcatggtatg

SEQ ID NO: 5867 - DNA, 19 bp, Artificial Sequence
  Description of Artificial Sequence: Chemically synthesized oligonucleotide
ataccatgcctggctctcc

SEQ ID NO: 5868 - DNA, 19 bp, Artificial Sequence
  Description of Artificial Sequence: Chemically synthesized oligonucleotide
ggagagccaggcatggtat

SEQ ID NO: 5869 - DNA, 19 bp, Artificial Sequence
  Description of Artificial Sequence: Chemically synthesized oligonucleotide
taccatgcctggctctccc

SEQ ID NO: 5870 - DNA, 19 bp, Artificial Sequence
  Description of Artificial Sequence: Chemically synthesized oligonucleotide
gggagagccaggcatggta

SEQ ID NO: 5871 - DNA, 19 bp, Artificial Sequence
  Description of Artificial Sequence: Chemically synthesized oligonucleotide
accatgcctggctctccct

SEQ ID NO: 5872 - DNA, 19 bp, Artificial Sequence
  Description of Artificial Sequence: Chemically synthesized oligonucleotide
agggagagccaggcatggt

SEQ ID NO: 5873 - DNA, 19 bp, Artificial Sequence
  Description of Artificial Sequence: Chemically synthesized oligonucleotide
ccatgcctggctctccctg

SEQ ID NO: 5874 - DNA, 19 bp, Artificial Sequence
  Description of Artificial Sequence: Chemically synthesized oligonucleotide
cagggagagccaggcatgg

SEQ ID NO: 5875 - DNA, 19 bp, Artificial Sequence
  Description of Artificial Sequence: Chemically synthesized oligonucleotide
catgcctggctctccctgc

SEQ ID NO: 5876 - DNA, 19 bp, Artificial Sequence
  Description of Artificial Sequence: Chemically synthesized oligonucleotide
gcagggagagccaggcatg

SEQ ID NO: 5877 - DNA, 19 bp, Artificial Sequence
  Description of Artificial Sequence: Chemically synthesized oligonucleotide
atgcctggctctccctgca

SEQ ID NO: 5878 - DNA, 19 bp, Artificial Sequence
  Description of Artificial Sequence: Chemically synthesized oligonucleotide
tgcagggagagccaggcat

SEQ ID NO: 5879 - DNA, 19 bp, Artificial Sequence
  Description of Artificial Sequence: Chemically synthesized oligonucleotide
tgcctggctctccctgcaa

SEQ ID NO: 5880 - DNA, 19 bp, Artificial Sequence
  Description of Artificial Sequence: Chemically synthesized oligonucleotide
ttgcagggagagccaggca

SEQ ID NO: 5881 - DNA, 19 bp, Artificial Sequence
  Description of Artificial Sequence: Chemically synthesized oligonucleotide
gcctggctctccctgcaaa

SEQ ID NO: 5882 - DNA, 19 bp, Artificial Sequence
  Description of Artificial Sequence: Chemically synthesized oligonucleotide
tttgcagggagagccaggc

SEQ ID NO: 5883 - DNA, 19 bp, Artificial Sequence
  Description of Artificial Sequence: Chemically synthesized oligonucleotide
cctggctctccctgcaaaa

SEQ ID NO: 5884 - DNA, 19 bp, Artificial Sequence
  Description of Artificial Sequence: Chemically synthesized oligonucleotide
ttttgcagggagagccagg

SEQ ID NO: 5885 - DNA, 19 bp, Artificial Sequence
  Description of Artificial Sequence: Chemically synthesized oligonucleotide
ctggctctccctgcaaaac

SEQ ID NO: 5886 - DNA, 19 bp, Artificial Sequence
  Description of Artificial Sequence: Chemically synthesized oligonucleotide
gttttgcagggagagccag

SEQ ID NO: 5887 - DNA, 19 bp, Artificial Sequence
  Description of Artificial Sequence: Chemically synthesized oligonucleotide
tggctctccctgcaaaact

SEQ ID NO: 5888 - DNA, 19 bp, Artificial Sequence
  Description of Artificial Sequence: Chemically synthesized oligonucleotide
agttttgcagggagagcca

SEQ ID NO: 5889 - DNA, 19 bp, Artificial Sequence
  Description of Artificial Sequence: Chemically synthesized oligonucleotide
ggctctccctgcaaaactg

SEQ ID NO: 5890 - DNA, 19 bp, Artificial Sequence
  Description of Artificial Sequence: Chemically synthesized oligonucleotide
cagttttgcagggagagcc

SEQ ID NO: 5891 - DNA, 19 bp, Artificial Sequence
  Description of Artificial Sequence: Chemically synthesized oligonucleotide
gctctccctgcaaaactgg

SEQ ID NO: 5892 - DNA, 19 bp, Artificial Sequence
  Description of Artificial Sequence: Chemically synthesized oligonucleotide
ccagttttgcagggagagc

SEQ ID NO: 5893 - DNA, 19 bp, Artificial Sequence
  Description of Artificial Sequence: Chemically synthesized oligonucleotide
ctctccctgcaaaactggc

SEQ ID NO: 5894 - DNA, 19 bp, Artificial Sequence
  Description of Artificial Sequence: Chemically synthesized oligonucleotide
gccagttttgcagggagag

SEQ ID NO: 5895 - DNA, 19 bp, Artificial Sequence
  Description of Artificial Sequence: Chemically synthesized oligonucleotide
tctccctgcaaaactggct

SEQ ID NO: 5896 - DNA, 19 bp, Artificial Sequence
  Description of Artificial Sequence: Chemically synthesized oligonucleotide
agccagttttgcagggaga

SEQ ID NO: 5897 - DNA, 19 bp, Artificial Sequence
  Description of Artificial Sequence: Chemically synthesized oligonucleotide
ctccctgcaaaactggctc

SEQ ID NO: 5898 - DNA, 19 bp, Artificial Sequence
  Description of Artificial Sequence: Chemically synthesized oligonucleotide
gagccagttttgcagggag

SEQ ID NO: 5899 - DNA, 19 bp, Artificial Sequence
  Description of Artificial Sequence: Chemically synthesized oligonucleotide
tccctgcaaaactggctca

SEQ ID NO: 5900 - DNA, 19 bp, Artificial Sequence
  Description of Artificial Sequence: Chemically synthesized oligonucleotide
tgagccagttttgcaggga

SEQ ID NO: 5901 - DNA, 19 bp, Artificial Sequence
  Description of Artificial Sequence: Chemically synthesized oligonucleotide
ccctgcaaaactggctcaa

SEQ ID NO: 5902 - DNA, 19 bp, Artificial Sequence
  Description of Artificial Sequence: Chemically synthesized oligonucleotide
ttgagccagttttgcaggg

SEQ ID NO: 5903 - DNA, 19 bp, Artificial Sequence
  Description of Artificial Sequence: Chemically synthesized oligonucleotide
cctgcaaaactggctcaat

SEQ ID NO: 5904 - DNA, 19 bp, Artificial Sequence
  Description of Artificial Sequence: Chemically synthesized oligonucleotide
attgagccagttttgcagg

SEQ ID NO: 5905 - DNA, 19 bp, Artificial Sequence
  Description of Artificial Sequence: Chemically synthesized oligonucleotide
ctgcaaaactggctcaatg

SEQ ID NO: 5906 - DNA, 19 bp, Artificial Sequence
  Description of Artificial Sequence: Chemically synthesized oligonucleotide
cattgagccagttttgcag

SEQ ID NO: 5907 - DNA, 19 bp, Artificial Sequence
  Description of Artificial Sequence: Chemically synthesized oligonucleotide
tgcaaaactggctcaatgc

SEQ ID NO: 5908 - DNA, 19 bp, Artificial Sequence
  Description of Artificial Sequence: Chemically synthesized oligonucleotide
gcattgagccagttttgca

SEQ ID NO: 5909 - DNA, 19 bp, Artificial Sequence
  Description of Artificial Sequence: Chemically synthesized oligonucleotide
gcaaaactggctcaatgcc

SEQ ID NO: 5910 - DNA, 19 bp, Artificial Sequence
  Description of Artificial Sequence: Chemically synthesized oligonucleotide
ggcattgagccagttttgc

SEQ ID NO: 5911 - DNA, 19 bp, Artificial Sequence
  Description of Artificial Sequence: Chemically synthesized oligonucleotide
caaaactggctcaatgcca

SEQ ID NO: 5912 - DNA, 19 bp, Artificial Sequence
  Description of Artificial Sequence: Chemically synthesized oligonucleotide
tggcattgagccagttttg

SEQ ID NO: 5913 - DNA, 19 bp, Artificial Sequence
  Description of Artificial Sequence: Chemically synthesized oligonucleotide
aaaactggctcaatgccaa

SEQ ID NO: 5914 - DNA, 19 bp, Artificial Sequence
  Description of Artificial Sequence: Chemically synthesized oligonucleotide
ttggcattgagccagtttt

SEQ ID NO: 5915 - DNA, 19 bp, Artificial Sequence
  Description of Artificial Sequence: Chemically synthesized oligonucleotide
aaactggctcaatgccaaa

SEQ ID NO: 5916 - DNA, 19 bp, Artificial Sequence
  Description of Artificial Sequence: Chemically synthesized oligonucleotide
tttggcattgagccagttt

SEQ ID NO: 5917 - DNA, 19 bp, Artificial Sequence
  Description of Artificial Sequence: Chemically synthesized oligonucleotide
aactggctcaatgccaaag

SEQ ID NO: 5918 - DNA, 19 bp, Artificial Sequence
  Description of Artificial Sequence: Chemically synthesized oligonucleotide
ctttggcattgagccagtt

SEQ ID NO: 5919 - DNA, 19 bp, Artificial Sequence
  Description of Artificial Sequence: Chemically synthesized oligonucleotide
actggctcaatgccaaagt

SEQ ID NO: 5920 - DNA, 19 bp, Artificial Sequence
  Description of Artificial Sequence: Chemically synthesized oligonucleotide
actttggcattgagccagt

SEQ ID NO: 5921 - DNA, 19 bp, Artificial Sequence
  Description of Artificial Sequence: Chemically synthesized oligonucleotide
ctggctcaatgccaaagtt

SEQ ID NO: 5922 - DNA, 19 bp, Artificial Sequence
  Description of Artificial Sequence: Chemically synthesized oligonucleotide
aactttggcattgagccag

SEQ ID NO: 5923 - DNA, 19 bp, Artificial Sequence
  Description of Artificial Sequence: Chemically synthesized oligonucleotide
tggctcaatgccaaagttg

SEQ ID NO: 5924 - DNA, 19 bp, Artificial Sequence
  Description of Artificial Sequence: Chemically synthesized oligonucleotide
caactttggcattgagcca

SEQ ID NO: 5925 - DNA, 19 bp, Artificial Sequence
  Description of Artificial Sequence: Chemically synthesized oligonucleotide
ggctcaatgccaaagttgt

SEQ ID NO: 5926 - DNA, 19 bp, Artificial Sequence
  Description of Artificial Sequence: Chemically synthesized oligonucleotide
acaactttggcattgagcc

SEQ ID NO: 5927 - DNA, 19 bp, Artificial Sequence
  Description of Artificial Sequence: Chemically synthesized oligonucleotide
gctcaatgccaaagttgtg

SEQ ID NO: 5928 - DNA, 19 bp, Artificial Sequence
  Description of Artificial Sequence: Chemically synthesized oligonucleotide
cacaactttggcattgagc

SEQ ID NO: 5929 - DNA, 19 bp, Artificial Sequence
  Description of Artificial Sequence: Chemically synthesized oligonucleotide
ctcaatgccaaagttgtgc

SEQ ID NO: 5930 - DNA, 19 bp, Artificial Sequence
  Description of Artificial Sequence: Chemically synthesized oligonucleotide
gcacaactttggcattgag

SEQ ID NO: 5931 - DNA, 19 bp, Artificial Sequence
  Description of Artificial Sequence: Chemically synthesized oligonucleotide
tcaatgccaaagttgtgcc

SEQ ID NO: 5932 - DNA, 19 bp, Artificial Sequence
  Description of Artificial Sequence: Chemically synthesized oligonucleotide
ggcacaactttggcattga

SEQ ID NO: 5933 - DNA, 19 bp, Artificial Sequence
  Description of Artificial Sequence: Chemically synthesized oligonucleotide
caatgccaaagttgtgccc

SEQ ID NO: 5934 - DNA, 19 bp, Artificial Sequence
  Description of Artificial Sequence: Chemically synthesized oligonucleotide
gggcacaactttggcattg

SEQ ID NO: 5935 - DNA, 19 bp, Artificial Sequence
  Description of Artificial Sequence: Chemically synthesized oligonucleotide
aatgccaaagttgtgccca

SEQ ID NO: 5936 - DNA, 19 bp, Artificial Sequence
  Description of Artificial Sequence: Chemically synthesized oligonucleotide
tgggcacaactttggcatt

SEQ ID NO: 5937 - DNA, 19 bp, Artificial Sequence
  Description of Artificial Sequence: Chemically synthesized oligonucleotide
atgccaaagttgtgcccag

SEQ ID NO: 5938 - DNA, 19 bp, Artificial Sequence
  Description of Artificial Sequence: Chemically synthesized oligonucleotide
ctgggcacaactttggcat

SEQ ID NO: 5939 - DNA, 19 bp, Artificial Sequence
  Description of Artificial Sequence: Chemically synthesized oligonucleotide
tgccaaagttgtgcccagg

SEQ ID NO: 5940 - DNA, 19 bp, Artificial Sequence
  Description of Artificial Sequence: Chemically synthesized oligonucleotide
cctgggcacaactttggca

SEQ ID NO: 5941 - DNA, 19 bp, Artificial Sequence
  Description of Artificial Sequence: Chemically synthesized oligonucleotide
gccaaagttgtgcccaggc

SEQ ID NO: 5942 - DNA, 19 bp, Artificial Sequence
  Description of Artificial Sequence: Chemically synthesized oligonucleotide
gcctgggcacaactttggc

SEQ ID NO: 5943 - DNA, 19 bp, Artificial Sequence
  Description of Artificial Sequence: Chemically synthesized oligonucleotide
ccaaagttgtgcccaggca

SEQ ID NO: 5944 - DNA, 19 bp, Artificial Sequence
  Description of Artificial Sequence: Chemically synthesized oligonucleotide
tgcctgggcacaactttgg

SEQ ID NO: 5945 - DNA, 19 bp, Artificial Sequence
  Description of Artificial Sequence: Chemically synthesized oligonucleotide
caaagttgtgcccaggcag

SEQ ID NO: 5946 - DNA, 19 bp, Artificial Sequence
  Description of Artificial Sequence: Chemically synthesized oligonucleotide
ctgcctgggcacaactttg

SEQ ID NO: 5947 - DNA, 19 bp, Artificial Sequence
  Description of Artificial Sequence: Chemically synthesized oligonucleotide
aaagttgtgcccaggcagc

SEQ ID NO: 5948 - DNA, 19 bp, Artificial Sequence
  Description of Artificial Sequence: Chemically synthesized oligonucleotide
gctgcctgggcacaacttt

SEQ ID NO: 5949 - DNA, 19 bp, Artificial Sequence
  Description of Artificial Sequence: Chemically synthesized oligonucleotide
aagttgtgcccaggcagct

SEQ ID NO: 5950 - DNA, 19 bp, Artificial Sequence
  Description of Artificial Sequence: Chemically synthesized oligonucleotide
agctgcctgggcacaactt

SEQ ID NO: 5951 - DNA, 19 bp, Artificial Sequence
  Description of Artificial Sequence: Chemically synthesized oligonucleotide
agttgtgcccaggcagctg

SEQ ID NO: 5952 - DNA, 19 bp, Artificial Sequence
  Description of Artificial Sequence: Chemically synthesized oligonucleotide
cagctgcctgggcacaact

SEQ ID NO: 5953 - DNA, 19 bp, Artificial Sequence
  Description of Artificial Sequence: Chemically synthesized oligonucleotide
gttgtgcccaggcagctgg

SEQ ID NO: 5954 - DNA, 19 bp, Artificial Sequence
  Description of Artificial Sequence: Chemically synthesized oligonucleotide
ccagctgcctgggcacaac

SEQ ID NO: 5955 - DNA, 19 bp, Artificial Sequence
  Description of Artificial Sequence: Chemically synthesized oligonucleotide
ttgtgcccaggcagctgga

SEQ ID NO: 5956 - DNA, 19 bp, Artificial Sequence
  Description of Artificial Sequence: Chemically synthesized oligonucleotide
tccagctgcctgggcacaa

SEQ ID NO: 5957 - DNA, 19 bp, Artificial Sequence
  Description of Artificial Sequence: Chemically synthesized oligonucleotide
tgtgcccaggcagctggag

SEQ ID NO: 5958 - DNA, 19 bp, Artificial Sequence
  Description of Artificial Sequence: Chemically synthesized oligonucleotide
ctccagctgcctgggcaca

SEQ ID NO: 5959 - DNA, 19 bp, Artificial Sequence
  Description of Artificial Sequence: Chemically synthesized oligonucleotide
gtgcccaggcagctggaga

SEQ ID NO: 5960 - DNA, 19 bp, Artificial Sequence
  Description of Artificial Sequence: Chemically synthesized oligonucleotide
tctccagctgcctgggcac

SEQ ID NO: 5961 - DNA, 19 bp, Artificial Sequence
  Description of Artificial Sequence: Chemically synthesized oligonucleotide
tgcccaggcagctggagag

SEQ ID NO: 5962 - DNA, 19 bp, Artificial Sequence
  Description of Artificial Sequence: Chemically synthesized oligonucleotide
ctctccagctgcctgggca

SEQ ID NO: 5963 - DNA, 19 bp, Artificial Sequence
  Description of Artificial Sequence: Chemically synthesized oligonucleotide
gcccaggcagctggagagg

SEQ ID NO: 5964 - DNA, 19 bp, Artificial Sequence
  Description of Artificial Sequence: Chemically synthesized oligonucleotide
cctctccagctgcctgggc

SEQ ID NO: 5965 - DNA, 19 bp, Artificial Sequence
  Description of Artificial Sequence: Chemically synthesized oligonucleotide
cccaggcagctggagaggg

SEQ ID NO: 5966 - DNA, 19 bp, Artificial Sequence
  Description of Artificial Sequence: Chemically synthesized oligonucleotide
ccctctccagctgcctggg

SEQ ID NO: 5967 - DNA, 19 bp, Artificial Sequence
  Description of Artificial Sequence: Chemically synthesized oligonucleotide
ccaggcagctggagaggga

SEQ ID NO: 5968 - DNA, 19 bp, Artificial Sequence
  Description of Artificial Sequence: Chemically synthesized oligonucleotide
tccctctccagctgcctgg

SEQ ID NO: 5969 - DNA, 19 bp, Artificial Sequence
  Description of Artificial Sequence: Chemically synthesized oligonucleotide
caggcagctggagagggag

SEQ ID NO: 5970 - DNA, 19 bp, Artificial Sequence
  Description of Artificial Sequence: Chemically synthesized oligonucleotide
ctccctctccagctgcctg

SEQ ID NO: 5971 - DNA, 19 bp, Artificial Sequence
  Description of Artificial Sequence: Chemically synthesized oligonucleotide
aggcagctggagagggagg

SEQ ID NO: 5972 - DNA, 19 bp, Artificial Sequence
  Description of Artificial Sequence: Chemically synthesized oligonucleotide
cctccctctccagctgcct

SEQ ID NO: 5973 - DNA, 19 bp, Artificial Sequence
  Description of Artificial Sequence: Chemically synthesized oligonucleotide
ggcagctggagagggagga

SEQ ID NO: 5974 - DNA, 19 bp, Artificial Sequence
  Description of Artificial Sequence: Chemically synthesized oligonucleotide
tcctccctctccagctgcc

SEQ ID NO: 5975 - DNA, 19 bp, Artificial Sequence
  Description of Artificial Sequence: Chemically synthesized oligonucleotide
gcagctggagagggaggag

SEQ ID NO: 5976 - DNA, 19 bp, Artificial Sequence
  Description of Artificial Sequence: Chemically synthesized oligonucleotide
ctcctccctctccagctgc

SEQ ID NO: 5977 - DNA, 19 bp, Artificial Sequence
  Description of Artificial Sequence: Chemically synthesized oligonucleotide
cagctggagagggaggagg

SEQ ID NO: 5978 - DNA, 19 bp, Artificial Sequence
  Description of Artificial Sequence: Chemically synthesized oligonucleotide
cctcctccctctccagctg

SEQ ID NO: 5979 - DNA, 19 bp, Artificial Sequence
  Description of Artificial Sequence: Chemically synthesized oligonucleotide
agctggagagggaggaggg

SEQ ID NO: 5980 - DNA, 19 bp, Artificial Sequence
  Description of Artificial Sequence: Chemically synthesized oligonucleotide
ccctcctccctctccagct

SEQ ID NO: 5981 - DNA, 19 bp, Artificial Sequence
  Description of Artificial Sequence: Chemically synthesized oligonucleotide
gctggagagggaggagggc

SEQ ID NO: 5982 - DNA, 19 bp, Artificial Sequence
  Description of Artificial Sequence: Chemically synthesized oligonucleotide
gccctcctccctctccagc

SEQ ID NO: 5983 - DNA, 19 bp, Artificial Sequence
  Description of Artificial Sequence: Chemically synthesized oligonucleotide
ctggagagggaggagggca

SEQ ID NO: 5984 - DNA, 19 bp, Artificial Sequence
  Description of Artificial Sequence: Chemically synthesized oligonucleotide
tgccctcctccctctccag

SEQ ID NO: 5985 - DNA, 19 bp, Artificial Sequence
  Description of Artificial Sequence: Chemically synthesized oligonucleotide
tggagagggaggagggcac

SEQ ID NO: 5986 - DNA, 19 bp, Artificial Sequence
  Description of Artificial Sequence: Chemically synthesized oligonucleotide
gtgccctcctccctctcca

SEQ ID NO: 5987 - DNA, 19 bp, Artificial Sequence
  Description of Artificial Sequence: Chemically synthesized oligonucleotide
ggagagggaggagggcacg

SEQ ID NO: 5988 - DNA, 19 bp, Artificial Sequence
  Description of Artificial Sequence: Chemically synthesized oligonucleotide
cgtgccctcctccctctcc

SEQ ID NO: 5989 - DNA, 19 bp, Artificial Sequence
  Description of Artificial Sequence: Chemically synthesized oligonucleotide
gagagggaggagggcacgc

SEQ ID NO: 5990 - DNA, 19 bp, Artificial Sequence
  Description of Artificial Sequence: Chemically synthesized oligonucleotide
gcgtgccctcctccctctc

SEQ ID NO: 5991 - DNA, 19 bp, Artificial Sequence
  Description of Artificial Sequence: Chemically synthesized oligonucleotide
agagggaggagggcacgcc

SEQ ID NO: 5992 - DNA, 19 bp, Artificial Sequence
  Description of Artificial Sequence: Chemically synthesized oligonucleotide
ggcgtgccctcctccctct

SEQ ID NO: 5993 - DNA, 19 bp, Artificial Sequence
  Description of Artificial Sequence: Chemically synthesized oligonucleotide
gagggaggagggcacgcct

SEQ ID NO: 5994 - DNA, 19 bp, Artificial Sequence
  Description of Artificial Sequence: Chemically synthesized oligonucleotide
aggcgtgccctcctccctc

SEQ ID NO: 5995 - DNA, 19 bp, Artificial Sequence
  Description of Artificial Sequence: Chemically synthesized oligonucleotide
agggaggagggcacgcctg

SEQ ID NO: 5996 - DNA, 19 bp, Artificial Sequence
  Description of Artificial Sequence: Chemically synthesized oligonucleotide
caggcgtgccctcctccct

SEQ ID NO: 5997 - DNA, 19 bp, Artificial Sequence
  Description of Artificial Sequence: Chemically synthesized oligonucleotide
gggaggagggcacgcctgc

SEQ ID NO: 5998 - DNA, 19 bp, Artificial Sequence
  Description of Artificial Sequence: Chemically synthesized oligonucleotide
gcaggcgtgccctcctccc

SEQ ID NO: 5999 - DNA, 19 bp, Artificial Sequence
  Description of Artificial Sequence: Chemically synthesized oligonucleotide
ggaggagggcacgcctgcc

SEQ ID NO: 6000 - DNA, 19 bp, Artificial Sequence
  Description of Artificial Sequence: Chemically synthesized oligonucleotide
ggcaggcgtgccctcctcc

SEQ ID NO: 6001 - DNA, 19 bp, Artificial Sequence
  Description of Artificial Sequence: Chemically synthesized oligonucleotide
gaggagggcacgcctgcca

SEQ ID NO: 6002 - DNA, 19 bp, Artificial Sequence
  Description of Artificial Sequence: Chemically synthesized oligonucleotide
tggcaggcgtgccctcctc

SEQ ID NO: 6003 - DNA, 19 bp, Artificial Sequence
  Description of Artificial Sequence: Chemically synthesized oligonucleotide
aggagggcacgcctgccac

SEQ ID NO: 6004 - DNA, 19 bp, Artificial Sequence
  Description of Artificial Sequence: Chemically synthesized oligonucleotide
gtggcaggcgtgccctcct

SEQ ID NO: 6005 - DNA, 19 bp, Artificial Sequence
  Description of Artificial Sequence: Chemically synthesized oligonucleotide
ggagggcacgcctgccact

SEQ ID NO: 6006 - DNA, 19 bp, Artificial Sequence
  Description of Artificial Sequence: Chemically synthesized oligonucleotide
agtggcaggcgtgccctcc

SEQ ID NO: 6007 - DNA, 19 bp, Artificial Sequence
  Description of Artificial Sequence: Chemically synthesized oligonucleotide
gagggcacgcctgccactc

SEQ ID NO: 6008 - DNA, 19 bp, Artificial Sequence
  Description of Artificial Sequence: Chemically synthesized oligonucleotide
gagtggcaggcgtgccctc

SEQ ID NO: 6009 - DNA, 19 bp, Artificial Sequence
  Description of Artificial Sequence: Chemically synthesized oligonucleotide
agggcacgcctgccactct

SEQ ID NO: 6010 - DNA, 19 bp, Artificial Sequence
  Description of Artificial Sequence: Chemically synthesized oligonucleotide
agagtggcaggcgtgccct

SEQ ID NO: 6011 - DNA, 19 bp, Artificial Sequence
  Description of Artificial Sequence: Chemically synthesized oligonucleotide
gggcacgcctgccactctc

SEQ ID NO: 6012 - DNA, 19 bp, Artificial Sequence
  Description of Artificial Sequence: Chemically synthesized oligonucleotide
gagagtggcaggcgtgccc

SEQ ID NO: 6013 - DNA, 19 bp, Artificial Sequence
  Description of Artificial Sequence: Chemically synthesized oligonucleotide
ggcacgcctgccactctca

SEQ ID NO: 6014 - DNA, 19 bp, Artificial Sequence
  Description of Artificial Sequence: Chemically synthesized oligonucleotide
tgagagtggcaggcgtgcc

SEQ ID NO: 6015 - DNA, 19 bp, Artificial Sequence
  Description of Artificial Sequence: Chemically synthesized oligonucleotide
gcacgcctgccactctcag

SEQ ID NO: 6016 - DNA, 19 bp, Artificial Sequence
  Description of Artificial Sequence: Chemically synthesized oligonucleotide
ctgagagtggcaggcgtgc

SEQ ID NO: 6017 - DNA, 19 bp, Artificial Sequence
  Description of Artificial Sequence: Chemically synthesized oligonucleotide
cacgcctgccactctcagc

SEQ ID NO: 6018 - DNA, 19 bp, Artificial Sequence
  Description of Artificial Sequence: Chemically synthesized oligonucleotide
gctgagagtggcaggcgtg

SEQ ID NO: 6019 - DNA, 19 bp, Artificial Sequence
  Description of Artificial Sequence: Chemically synthesized oligonucleotide
acgcctgccactctcagca

SEQ ID NO: 6020 - DNA, 19 bp, Artificial Sequence
  Description of Artificial Sequence: Chemically synthesized oligonucleotide
tgctgagagtggcaggcgt

SEQ ID NO: 6021 - DNA, 19 bp, Artificial Sequence
  Description of Artificial Sequence: Chemically synthesized oligonucleotide
cgcctgccactctcagcaa

SEQ ID NO: 6022 - DNA, 19 bp, Artificial Sequence
  Description of Artificial Sequence: Chemically synthesized oligonucleotide
ttgctgagagtggcaggcg

SEQ ID NO: 6023 - DNA, 19 bp, Artificial Sequence
  Description of Artificial Sequence: Chemically synthesized oligonucleotide
gcctgccactctcagcaag

SEQ ID NO: 6024 - DNA, 19 bp, Artificial Sequence
  Description of Artificial Sequence: Chemically synthesized oligonucleotide
cttgctgagagtggcaggc

SEQ ID NO: 6025 - DNA, 19 bp, Artificial Sequence
  Description of Artificial Sequence: Chemically synthesized oligonucleotide
cctgccactctcagcaagt

SEQ ID NO: 6026 - DNA, 19 bp, Artificial Sequence
  Description of Artificial Sequence: Chemically synthesized oligonucleotide
acttgctgagagtggcagg

SEQ ID NO: 6027 - DNA, 19 bp, Artificial Sequence
  Description of Artificial Sequence: Chemically synthesized oligonucleotide
ctgccactctcagcaagtg

SEQ ID NO: 6028 - DNA, 19 bp, Artificial Sequence
  Description of Artificial Sequence: Chemically synthesized oligonucleotide
cacttgctgagagtggcag

SEQ ID NO: 6029 - DNA, 19 bp, Artificial Sequence
  Description of Artificial Sequence: Chemically synthesized oligonucleotide
tgccactctcagcaagtgc

SEQ ID NO: 6030 - DNA, 19 bp, Artificial Sequence
  Description of Artificial Sequence: Chemically synthesized oligonucleotide
gcacttgctgagagtggca

SEQ ID NO: 6031 - DNA, 19 bp, Artificial Sequence
  Description of Artificial Sequence: Chemically synthesized oligonucleotide
gccactctcagcaagtgcg

SEQ ID NO: 6032 - DNA, 19 bp, Artificial Sequence
  Description of Artificial Sequence: Chemically synthesized oligonucleotide
cgcacttgctgagagtggc

SEQ ID NO: 6033 - DNA, 19 bp, Artificial Sequence
  Description of Artificial Sequence: Chemically synthesized oligonucleotide
ccactctcagcaagtgcgg

SEQ ID NO: 6034 - DNA, 19 bp, Artificial Sequence
  Description of Artificial Sequence: Chemically synthesized oligonucleotide
ccgcacttgctgagagtgg

SEQ ID NO: 6035 - DNA, 19 bp, Artificial Sequence
  Description of Artificial Sequence: Chemically synthesized oligonucleotide
cactctcagcaagtgcgga

SEQ ID NO: 6036 - DNA, 19 bp, Artificial Sequence
  Description of Artificial Sequence: Chemically synthesized oligonucleotide
tccgcacttgctgagagtg

SEQ ID NO: 6037 - DNA, 19 bp, Artificial Sequence
  Description of Artificial Sequence: Chemically synthesized oligonucleotide
actctcagcaagtgcggag

SEQ ID NO: 6038 - DNA, 19 bp, Artificial Sequence
  Description of Artificial Sequence: Chemically synthesized oligonucleotide
ctccgcacttgctgagagt

SEQ ID NO: 6039 - DNA, 19 bp, Artificial Sequence
  Description of Artificial Sequence: Chemically synthesized oligonucleotide
ctctcagcaagtgcggaga

SEQ ID NO: 6040 - DNA, 19 bp, Artificial Sequence
  Description of Artificial Sequence: Chemically synthesized oligonucleotide
tctccgcacttgctgagag

SEQ ID NO: 6041 - DNA, 19 bp, Artificial Sequence
  Description of Artificial Sequence: Chemically synthesized oligonucleotide
tctcagcaagtgcggagat

SEQ ID NO: 6042 - DNA, 19 bp, Artificial Sequence
  Description of Artificial Sequence: Chemically synthesized oligonucleotide
atctccgcacttgctgaga

SEQ ID NO: 6043 - DNA, 19 bp, Artificial Sequence
  Description of Artificial Sequence: Chemically synthesized oligonucleotide
ctcagcaagtgcggagatc

SEQ ID NO: 6044 - DNA, 19 bp, Artificial Sequence
  Description of Artificial Sequence: Chemically synthesized oligonucleotide
gatctccgcacttgctgag

SEQ ID NO: 6045 - DNA, 19 bp, Artificial Sequence
  Description of Artificial Sequence: Chemically synthesized oligonucleotide
tcagcaagtgcggagatcg

SEQ ID NO: 6046 - DNA, 19 bp, Artificial Sequence
  Description of Artificial Sequence: Chemically synthesized oligonucleotide
cgatctccgcacttgctga

SEQ ID NO: 6047 - DNA, 19 bp, Artificial Sequence
  Description of Artificial Sequence: Chemically synthesized oligonucleotide
cagcaagtgcggagatcgc

SEQ ID NO: 6048 - DNA, 19 bp, Artificial Sequence
  Description of Artificial Sequence: Chemically synthesized oligonucleotide
gcgatctccgcacttgctg

SEQ ID NO: 6049 - DNA, 19 bp, Artificial Sequence
  Description of Artificial Sequence: Chemically synthesized oligonucleotide
agcaagtgcggagatcgcc

SEQ ID NO: 6050 - DNA, 19 bp, Artificial Sequence
  Description of Artificial Sequence: Chemically synthesized oligonucleotide
ggcgatctccgcacttgct

SEQ ID NO: 6051 - DNA, 19 bp, Artificial Sequence
  Description of Artificial Sequence: Chemically synthesized oligonucleotide
gcaagtgcggagatcgcct

SEQ ID NO: 6052 - DNA, 19 bp, Artificial Sequence
  Description of Artificial Sequence: Chemically synthesized oligonucleotide
aggcgatctccgcacttgc

SEQ ID NO: 6053 - DNA, 19 bp, Artificial Sequence
  Description of Artificial Sequence: Chemically synthesized oligonucleotide
caagtgcggagatcgcctc

SEQ ID NO: 6054 - DNA, 19 bp, Artificial Sequence
  Description of Artificial Sequence: Chemically synthesized oligonucleotide
gaggcgatctccgcacttg

SEQ ID NO: 6055 - DNA, 19 bp, Artificial Sequence
  Description of Artificial Sequence: Chemically synthesized oligonucleotide
aagtgcggagatcgcctct

SEQ ID NO: 6056 - DNA, 19 bp, Artificial Sequence
  Description of Artificial Sequence: Chemically synthesized oligonucleotide
agaggcgatctccgcactt

SEQ ID NO: 6057 - DNA, 19 bp, Artificial Sequence
  Description of Artificial Sequence: Chemically synthesized oligonucleotide
agtgcggagatcgcctctg

SEQ ID NO: 6058 - DNA, 19 bp, Artificial Sequence
  Description of Artificial Sequence: Chemically synthesized oligonucleotide
cagaggcgatctccgcact

SEQ ID NO: 6059 - DNA, 19 bp, Artificial Sequence
  Description of Artificial Sequence: Chemically synthesized oligonucleotide
gtgcggagatcgcctctgg

SEQ ID NO: 6060 - DNA, 19 bp, Artificial Sequence
  Description of Artificial Sequence: Chemically synthesized oligonucleotide
ccagaggcgatctccgcac

SEQ ID NO: 6061 - DNA, 19 bp, Artificial Sequence
  Description of Artificial Sequence: Chemically synthesized oligonucleotide
tgcggagatcgcctctggg

SEQ ID NO: 6062 - DNA, 19 bp, Artificial Sequence
  Description of Artificial Sequence: Chemically synthesized oligonucleotide
cccagaggcgatctccgca

SEQ ID NO: 6063 - DNA, 19 bp, Artificial Sequence
  Description of Artificial Sequence: Chemically synthesized oligonucleotide
gcggagatcgcctctggga

SEQ ID NO: 6064 - DNA, 19 bp, Artificial Sequence
  Description of Artificial Sequence: Chemically synthesized oligonucleotide
tcccagaggcgatctccgc

SEQ ID NO: 6065 - DNA, 19 bp, Artificial Sequence
  Description of Artificial Sequence: Chemically synthesized oligonucleotide
cggagatcgcctctgggag

SEQ ID NO: 6066 - DNA, 19 bp, Artificial Sequence
  Description of Artificial Sequence: Chemically synthesized oligonucleotide
ctcccagaggcgatctccg

SEQ ID NO: 6067 - DNA, 19 bp, Artificial Sequence
  Description of Artificial Sequence: Chemically synthesized oligonucleotide
ggagatcgcctctgggagg

SEQ ID NO: 6068 - DNA, 19 bp, Artificial Sequence
  Description of Artificial Sequence: Chemically synthesized oligonucleotide
cctcccagaggcgatctcc

SEQ ID NO: 6069 - DNA, 19 bp, Artificial Sequence
  Description of Artificial Sequence: Chemically synthesized oligonucleotide
gagatcgcctctgggaggg

SEQ ID NO: 6070 - DNA, 19 bp, Artificial Sequence
  Description of Artificial Sequence: Chemically synthesized oligonucleotide
ccctcccagaggcgatctc

SEQ ID NO: 6071 - DNA, 19 bp, Artificial Sequence
  Description of Artificial Sequence: Chemically synthesized oligonucleotide
agatcgcctctgggagggg

SEQ ID NO: 6072 - DNA, 19 bp, Artificial Sequence
  Description of Artificial Sequence: Chemically synthesized oligonucleotide
cccctcccagaggcgatct

SEQ ID NO: 6073 - DNA, 19 bp, Artificial Sequence
  Description of Artificial Sequence: Chemically synthesized oligonucleotide
gatcgcctctgggagggga

SEQ ID NO: 6074 - DNA, 19 bp, Artificial Sequence
  Description of Artificial Sequence: Chemically synthesized oligonucleotide
tcccctcccagaggcgatc

SEQ ID NO: 6075 - DNA, 19 bp, Artificial Sequence
  Description of Artificial Sequence: Chemically synthesized oligonucleotide
atcgcctctgggaggggag

SEQ ID NO: 6076 - DNA, 19 bp, Artificial Sequence
  Description of Artificial Sequence: Chemically synthesized oligonucleotide
ctcccctcccagaggcgat

SEQ ID NO: 6077 - DNA, 19 bp, Artificial Sequence
  Description of Artificial Sequence: Chemically synthesized oligonucleotide
tcgcctctgggaggggagc

SEQ ID NO: 6078 - DNA, 19 bp, Artificial Sequence
  Description of Artificial Sequence: Chemically synthesized oligonucleotide
gctcccctcccagaggcga

SEQ ID NO: 6079 - DNA, 19 bp, Artificial Sequence
  Description of Artificial Sequence: Chemically synthesized oligonucleotide
cgcctctgggaggggagct

SEQ ID NO: 6080 - DNA, 19 bp, Artificial Sequence
  Description of Artificial Sequence: Chemically synthesized oligonucleotide
agctcccctcccagaggcg

SEQ ID NO: 6081 - DNA, 19 bp, Artificial Sequence
  Description of Artificial Sequence: Chemically synthesized oligonucleotide
gcctctgggaggggagctg

SEQ ID NO: 6082 - DNA, 19 bp, Artificial Sequence
  Description of Artificial Sequence: Chemically synthesized oligonucleotide
cagctcccctcccagaggc

SEQ ID NO: 6083 - DNA, 19 bp, Artificial Sequence
  Description of Artificial Sequence: Chemically synthesized oligonucleotide
cctctgggaggggagctgc

SEQ ID NO: 6084 - DNA, 19 bp, Artificial Sequence
  Description of Artificial Sequence: Chemically synthesized oligonucleotide
gcagctcccctcccagagg

SEQ ID NO: 6085 - DNA, 19 bp, Artificial Sequence
  Description of Artificial Sequence: Chemically synthesized oligonucleotide
ctctgggaggggagctgca

SEQ ID NO: 6086 - DNA, 19 bp, Artificial Sequence
  Description of Artificial Sequence: Chemically synthesized oligonucleotide
tgcagctcccctcccagag

SEQ ID NO: 6087 - DNA, 19 bp, Artificial Sequence
  Description of Artificial Sequence: Chemically synthesized oligonucleotide
tctgggaggggagctgcag

SEQ ID NO: 6088 - DNA, 19 bp, Artificial Sequence
  Description of Artificial Sequence: Chemically synthesized oligonucleotide
ctgcagctcccctcccaga

SEQ ID NO: 6089 - DNA, 19 bp, Artificial Sequence
  Description of Artificial Sequence: Chemically synthesized oligonucleotide
ctgggaggggagctgcagc

SEQ ID NO: 6090 - DNA, 19 bp, Artificial Sequence
  Description of Artificial Sequence: Chemically synthesized oligonucleotide
gctgcagctcccctcccag

SEQ ID NO: 6091 - DNA, 19 bp, Artificial Sequence
  Description of Artificial Sequence: Chemically synthesized oligonucleotide
tgggaggggagctgcagca

SEQ ID NO: 6092 - DNA, 19 bp, Artificial Sequence
  Description of Artificial Sequence: Chemically synthesized oligonucleotide
tgctgcagctcccctccca

SEQ ID NO: 6093 - DNA, 19 bp, Artificial Sequence
  Description of Artificial Sequence: Chemically synthesized oligonucleotide
gggaggggagctgcagcag

SEQ ID NO: 6094 - DNA, 19 bp, Artificial Sequence
  Description of Artificial Sequence: Chemically synthesized oligonucleotide
ctgctgcagctcccctccc

SEQ ID NO: 6095 - DNA, 19 bp, Artificial Sequence
  Description of Artificial Sequence: Chemically synthesized oligonucleotide
ggaggggagctgcagcagg

SEQ ID NO: 6096 - DNA, 19 bp, Artificial Sequence
  Description of Artificial Sequence: Chemically synthesized oligonucleotide
cctgctgcagctcccctcc

SEQ ID NO: 6097 - DNA, 19 bp, Artificial Sequence
  Description of Artificial Sequence: Chemically synthesized oligonucleotide
gaggggagctgcagcagga

SEQ ID NO: 6098 - DNA, 19 bp, Artificial Sequence
  Description of Artificial Sequence: Chemically synthesized oligonucleotide
tcctgctgcagctcccctc

SEQ ID NO: 6099 - DNA, 19 bp, Artificial Sequence
  Description of Artificial Sequence: Chemically synthesized oligonucleotide
aggggagctgcagcaggag

SEQ ID NO: 6100 - DNA, 19 bp, Artificial Sequence
  Description of Artificial Sequence: Chemically synthesized oligonucleotide
ctcctgctgcagctcccct

SEQ ID NO: 6101 - DNA, 19 bp, Artificial Sequence
  Description of Artificial Sequence: Chemically synthesized oligonucleotide
ggggagctgcagcaggagg

SEQ ID NO: 6102 - DNA, 19 bp, Artificial Sequence
  Description of Artificial Sequence: Chemically synthesized oligonucleotide
cctcctgctgcagctcccc

SEQ ID NO: 6103 - DNA, 19 bp, Artificial Sequence
  Description of Artificial Sequence: Chemically synthesized oligonucleotide
gggagctgcagcaggagga

SEQ ID NO: 6104 - DNA, 19 bp, Artificial Sequence
  Description of Artificial Sequence: Chemically synthesized oligonucleotide
tcctcctgctgcagctccc

SEQ ID NO: 6105 - DNA, 19 bp, Artificial Sequence
  Description of Artificial Sequence: Chemically synthesized oligonucleotide
ggagctgcagcaggaggaa

SEQ ID NO: 6106 - DNA, 19 bp, Artificial Sequence
  Description of Artificial Sequence: Chemically synthesized oligonucleotide
ttcctcctgctgcagctcc

SEQ ID NO: 6107 - DNA, 19 bp, Artificial Sequence
  Description of Artificial Sequence: Chemically synthesized oligonucleotide
gagctgcagcaggaggaag

SEQ ID NO: 6108 - DNA, 19 bp, Artificial Sequence
  Description of Artificial Sequence: Chemically synthesized oligonucleotide
cttcctcctgctgcagctc

SEQ ID NO: 6109 - DNA, 19 bp, Artificial Sequence
  Description of Artificial Sequence: Chemically synthesized oligonucleotide
agctgcagcaggaggaaga

SEQ ID NO: 6110 - DNA, 19 bp, Artificial Sequence
  Description of Artificial Sequence: Chemically synthesized oligonucleotide
tcttcctcctgctgcagct

SEQ ID NO: 6111 - DNA, 19 bp, Artificial Sequence
  Description of Artificial Sequence: Chemically synthesized oligonucleotide
gctgcagcaggaggaagac

SEQ ID NO: 6112 - DNA, 19 bp, Artificial Sequence
  Description of Artificial Sequence: Chemically synthesized oligonucleotide
gtcttcctcctgctgcagc

SEQ ID NO: 6113 - DNA, 19 bp, Artificial Sequence
  Description of Artificial Sequence: Chemically synthesized oligonucleotide
ctgcagcaggaggaagaca

SEQ ID NO: 6114 - DNA, 19 bp, Artificial Sequence
  Description of Artificial Sequence: Chemically synthesized oligonucleotide
tgtcttcctcctgctgcag

SEQ ID NO: 6115 - DNA, 19 bp, Artificial Sequence
  Description of Artificial Sequence: Chemically synthesized oligonucleotide
tgcagcaggaggaagacac

SEQ ID NO: 6116 - DNA, 19 bp, Artificial Sequence
  Description of Artificial Sequence: Chemically synthesized oligonucleotide
gtgtcttcctcctgctgca

SEQ ID NO: 6117 - DNA, 19 bp, Artificial Sequence
  Description of Artificial Sequence: Chemically synthesized oligonucleotide
gcagcaggaggaagacaca

SEQ ID NO: 6118 - DNA, 19 bp, Artificial Sequence
  Description of Artificial Sequence: Chemically synthesized oligonucleotide
tgtgtcttcctcctgctgc

SEQ ID NO: 6119 - DNA, 19 bp, Artificial Sequence
  Description of Artificial Sequence: Chemically synthesized oligonucleotide
cagcaggaggaagacacag

SEQ ID NO: 6120 - DNA, 19 bp, Artificial Sequence
  Description of Artificial Sequence: Chemically synthesized oligonucleotide
ctgtgtcttcctcctgctg

SEQ ID NO: 6121 - DNA, 19 bp, Artificial Sequence
  Description of Artificial Sequence: Chemically synthesized oligonucleotide
agcaggaggaagacacagc

SEQ ID NO: 6122 - DNA, 19 bp, Artificial Sequence
  Description of Artificial Sequence: Chemically synthesized oligonucleotide
gctgtgtcttcctcctgct

SEQ ID NO: 6123 - DNA, 19 bp, Artificial Sequence
  Description of Artificial Sequence: Chemically synthesized oligonucleotide
gcaggaggaagacacagcc

SEQ ID NO: 6124 - DNA, 19 bp, Artificial Sequence
  Description of Artificial Sequence: Chemically synthesized oligonucleotide
ggctgtgtcttcctcctgc

SEQ ID NO: 6125 - DNA, 19 bp, Artificial Sequence
  Description of Artificial Sequence: Chemically synthesized oligonucleotide
caggaggaagacacagcca

SEQ ID NO: 6126 - DNA, 19 bp, Artificial Sequence
  Description of Artificial Sequence: Chemically synthesized oligonucleotide
tggctgtgtcttcctcctg

SEQ ID NO: 6127 - DNA, 19 bp, Artificial Sequence
  Description of Artificial Sequence: Chemically synthesized oligonucleotide
aggaggaagacacagccac

SEQ ID NO: 6128 - DNA, 19 bp, Artificial Sequence
  Description of Artificial Sequence: Chemically synthesized oligonucleotide
gtggctgtgtcttcctcct

SEQ ID NO: 6129 - DNA, 19 bp, Artificial Sequence
  Description of Artificial Sequence: Chemically synthesized oligonucleotide
ggaggaagacacagccacc

SEQ ID NO: 6130 - DNA, 19 bp, Artificial Sequence
  Description of Artificial Sequence: Chemically synthesized oligonucleotide
ggtggctgtgtcttcctcc

SEQ ID NO: 6131 - DNA, 19 bp, Artificial Sequence
  Description of Artificial Sequence: Chemically synthesized oligonucleotide
gaggaagacacagccacca

SEQ ID NO: 6132 - DNA, 19 bp, Artificial Sequence
  Description of Artificial Sequence: Chemically synthesized oligonucleotide
tggtggctgtgtcttcctc

SEQ ID NO: 6133 - DNA, 19 bp, Artificial Sequence
  Description of Artificial Sequence: Chemically synthesized oligonucleotide
aggaagacacagccaccaa

SEQ ID NO: 6134 - DNA, 19 bp, Artificial Sequence
  Description of Artificial Sequence: Chemically synthesized oligonucleotide
ttggtggctgtgtcttcct

SEQ ID NO: 6135 - DNA, 19 bp, Artificial Sequence
  Description of Artificial Sequence: Chemically synthesized oligonucleotide
ggaagacacagccaccaac

SEQ ID NO: 6136 - DNA, 19 bp, Artificial Sequence
  Description of Artificial Sequence: Chemically synthesized oligonucleotide
gttggtggctgtgtcttcc

SEQ ID NO: 6137 - DNA, 19 bp, Artificial Sequence
  Description of Artificial Sequence: Chemically synthesized oligonucleotide
gaagacacagccaccaact

SEQ ID NO: 6138 - DNA, 19 bp, Artificial Sequence
  Description of Artificial Sequence: Chemically synthesized oligonucleotide
agttggtggctgtgtcttc

SEQ ID NO: 6139 - DNA, 19 bp, Artificial Sequence
  Description of Artificial Sequence: Chemically synthesized oligonucleotide
aagacacagccaccaactc

SEQ ID NO: 6140 - DNA, 19 bp, Artificial Sequence
  Description of Artificial Sequence: Chemically synthesized oligonucleotide
gagttggtggctgtgtctt

SEQ ID NO: 6141 - DNA, 19 bp, Artificial Sequence
  Description of Artificial Sequence: Chemically synthesized oligonucleotide
agacacagccaccaactcc

SEQ ID NO: 6142 - DNA, 19 bp, Artificial Sequence
  Description of Artificial Sequence: Chemically synthesized oligonucleotide
ggagttggtggctgtgtct

SEQ ID NO: 6143 - DNA, 19 bp, Artificial Sequence
  Description of Artificial Sequence: Chemically synthesized oligonucleotide
gacacagccaccaactcca

SEQ ID NO: 6144 - DNA, 19 bp, Artificial Sequence
  Description of Artificial Sequence: Chemically synthesized oligonucleotide
tggagttggtggctgtgtc

SEQ ID NO: 6145 - DNA, 19 bp, Artificial Sequence
  Description of Artificial Sequence: Chemically synthesized oligonucleotide
acacagccaccaactccag

SEQ ID NO: 6146 - DNA, 19 bp, Artificial Sequence
  Description of Artificial Sequence: Chemically synthesized oligonucleotide
ctggagttggtggctgtgt

SEQ ID NO: 6147 - DNA, 19 bp, Artificial Sequence
  Description of Artificial Sequence: Chemically synthesized oligonucleotide
cacagccaccaactccagc

SEQ ID NO: 6148 - DNA, 19 bp, Artificial Sequence
  Description of Artificial Sequence: Chemically synthesized oligonucleotide
gctggagttggtggctgtg

SEQ ID NO: 6149 - DNA, 19 bp, Artificial Sequence
  Description of Artificial Sequence: Chemically synthesized oligonucleotide
acagccaccaactccagct

SEQ ID NO: 6150 - DNA, 19 bp, Artificial Sequence
  Description of Artificial Sequence: Chemically synthesized oligonucleotide
agctggagttggtggctgt

SEQ ID NO: 6151 - DNA, 19 bp, Artificial Sequence
  Description of Artificial Sequence: Chemically synthesized oligonucleotide
cagccaccaactccagctc

SEQ ID NO: 6152 - DNA, 19 bp, Artificial Sequence
  Description of Artificial Sequence: Chemically synthesized oligonucleotide
gagctggagttggtggctg

SEQ ID NO: 6153 - DNA, 19 bp, Artificial Sequence
  Description of Artificial Sequence: Chemically synthesized oligonucleotide
agccaccaactccagctct

SEQ ID NO: 6154 - DNA, 19 bp, Artificial Sequence
  Description of Artificial Sequence: Chemically synthesized oligonucleotide
agagctggagttggtggct

SEQ ID NO: 6155 - DNA, 19 bp, Artificial Sequence
  Description of Artificial Sequence: Chemically synthesized oligonucleotide
gccaccaactccagctctg

SEQ ID NO: 6156 - DNA, 19 bp, Artificial Sequence
  Description of Artificial Sequence: Chemically synthesized oligonucleotide
cagagctggagttggtggc

SEQ ID NO: 6157 - DNA, 19 bp, Artificial Sequence
  Description of Artificial Sequence: Chemically synthesized oligonucleotide
ccaccaactccagctctga

SEQ ID NO: 6158 - DNA, 19 bp, Artificial Sequence
  Description of Artificial Sequence: Chemically synthesized oligonucleotide
tcagagctggagttggtgg

SEQ ID NO: 6159 - DNA, 19 bp, Artificial Sequence
  Description of Artificial Sequence: Chemically synthesized oligonucleotide
caccaactccagctctgag

SEQ ID NO: 6160 - DNA, 19 bp, Artificial Sequence
  Description of Artificial Sequence: Chemically synthesized oligonucleotide
ctcagagctggagttggtg

SEQ ID NO: 6161 - DNA, 19 bp, Artificial Sequence
  Description of Artificial Sequence: Chemically synthesized oligonucleotide
accaactccagctctgagg

SEQ ID NO: 6162 - DNA, 19 bp, Artificial Sequence
  Description of Artificial Sequence: Chemically synthesized oligonucleotide
cctcagagctggagttggt

SEQ ID NO: 6163 - DNA, 19 bp, Artificial Sequence
  Description of Artificial Sequence: Chemically synthesized oligonucleotide
ccaactccagctctgagga

SEQ ID NO: 6164 - DNA, 19 bp, Artificial Sequence
  Description of Artificial Sequence: Chemically synthesized oligonucleotide
tcctcagagctggagttgg

SEQ ID NO: 6165 - DNA, 19 bp, Artificial Sequence
  Description of Artificial Sequence: Chemically synthesized oligonucleotide
caactccagctctgaggaa

SEQ ID NO: 6166 - DNA, 19 bp, Artificial Sequence
  Description of Artificial Sequence: Chemically synthesized oligonucleotide
ttcctcagagctggagttg

SEQ ID NO: 6167 - DNA, 19 bp, Artificial Sequence
  Description of Artificial Sequence: Chemically synthesized oligonucleotide
aactccagctctgaggaag

SEQ ID NO: 6168 - DNA, 19 bp, Artificial Sequence
  Description of Artificial Sequence: Chemically synthesized oligonucleotide
cttcctcagagctggagtt

SEQ ID NO: 6169 - DNA, 19 bp, Artificial Sequence
  Description of Artificial Sequence: Chemically synthesized oligonucleotide
actccagctctgaggaagg

SEQ ID NO: 6170 - DNA, 19 bp, Artificial Sequence
  Description of Artificial Sequence: Chemically synthesized oligonucleotide
ccttcctcagagctggagt

SEQ ID NO: 6171 - DNA, 19 bp, Artificial Sequence
  Description of Artificial Sequence: Chemically synthesized oligonucleotide
ctccagctctgaggaaggc

SEQ ID NO: 6172 - DNA, 19 bp, Artificial Sequence
  Description of Artificial Sequence: Chemically synthesized oligonucleotide
gccttcctcagagctggag

SEQ ID NO: 6173 - DNA, 19 bp, Artificial Sequence
  Description of Artificial Sequence: Chemically synthesized oligonucleotide
tccagctctgaggaaggcc

SEQ ID NO: 6174 - DNA, 19 bp, Artificial Sequence
  Description of Artificial Sequence: Chemically synthesized oligonucleotide
ggccttcctcagagctgga

SEQ ID NO: 6175 - DNA, 19 bp, Artificial Sequence
  Description of Artificial Sequence: Chemically synthesized oligonucleotide
ccagctctgaggaaggccc

SEQ ID NO: 6176 - DNA, 19 bp, Artificial Sequence
  Description of Artificial Sequence: Chemically synthesized oligonucleotide
gggccttcctcagagctgg

SEQ ID NO: 6177 - DNA, 19 bp, Artificial Sequence
  Description of Artificial Sequence: Chemically synthesized oligonucleotide
cagctctgaggaaggccca

SEQ ID NO: 6178 - DNA, 19 bp, Artificial Sequence
  Description of Artificial Sequence: Chemically synthesized oligonucleotide
tgggccttcctcagagctg

SEQ ID NO: 6179 - DNA, 19 bp, Artificial Sequence
  Description of Artificial Sequence: Chemically synthesized oligonucleotide
agctctgaggaaggcccag

SEQ ID NO: 6180 - DNA, 19 bp, Artificial Sequence
  Description of Artificial Sequence: Chemically synthesized oligonucleotide
ctgggccttcctcagagct

SEQ ID NO: 6181 - DNA, 19 bp, Artificial Sequence
  Description of Artificial Sequence: Chemically synthesized oligonucleotide
gctctgaggaaggcccagg

SEQ ID NO: 6182 - DNA, 19 bp, Artificial Sequence
  Description of Artificial Sequence: Chemically synthesized oligonucleotide
cctgggccttcctcagagc

SEQ ID NO: 6183 - DNA, 19 bp, Artificial Sequence
  Description of Artificial Sequence: Chemically synthesized oligonucleotide
ctctgaggaaggcccaggg

SEQ ID NO: 6184 - DNA, 19 bp, Artificial Sequence
  Description of Artificial Sequence: Chemically synthesized oligonucleotide
ccctgggccttcctcagag

SEQ ID NO: 6185 - DNA, 19 bp, Artificial Sequence
  Description of Artificial Sequence: Chemically synthesized oligonucleotide
tctgaggaaggcccagggt

SEQ ID NO: 6186 - DNA, 19 bp, Artificial Sequence
  Description of Artificial Sequence: Chemically synthesized oligonucleotide
accctgggccttcctcaga

SEQ ID NO: 6187 - DNA, 19 bp, Artificial Sequence
  Description of Artificial Sequence: Chemically synthesized oligonucleotide
ctgaggaaggcccagggtc

SEQ ID NO: 6188 - DNA, 19 bp, Artificial Sequence
  Description of Artificial Sequence: Chemically synthesized oligonucleotide
gaccctgggccttcctcag

SEQ ID NO: 6189 - DNA, 19 bp, Artificial Sequence
  Description of Artificial Sequence: Chemically synthesized oligonucleotide
tgaggaaggcccagggtcc

SEQ ID NO: 6190 - DNA, 19 bp, Artificial Sequence
  Description of Artificial Sequence: Chemically synthesized oligonucleotide
ggaccctgggccttcctca

SEQ ID NO: 6191 - DNA, 19 bp, Artificial Sequence
  Description of Artificial Sequence: Chemically synthesized oligonucleotide
gaggaaggcccagggtccg

SEQ ID NO: 6192 - DNA, 19 bp, Artificial Sequence
  Description of Artificial Sequence: Chemically synthesized oligonucleotide
cggaccctgggccttcctc

SEQ ID NO: 6193 - DNA, 19 bp, Artificial Sequence
  Description of Artificial Sequence: Chemically synthesized oligonucleotide
aggaaggcccagggtccgg

SEQ ID NO: 6194 - DNA, 19 bp, Artificial Sequence
  Description of Artificial Sequence: Chemically synthesized oligonucleotide
ccggaccctgggccttcct

SEQ ID NO: 6195 - DNA, 19 bp, Artificial Sequence
  Description of Artificial Sequence: Chemically synthesized oligonucleotide
ggaaggcccagggtccggc

SEQ ID NO: 6196 - DNA, 19 bp, Artificial Sequence
  Description of Artificial Sequence: Chemically synthesized oligonucleotide
gccggaccctgggccttcc

SEQ ID NO: 6197 - DNA, 19 bp, Artificial Sequence
  Description of Artificial Sequence: Chemically synthesized oligonucleotide
gaaggcccagggtccggcc

SEQ ID NO: 6198 - DNA, 19 bp, Artificial Sequence
  Description of Artificial Sequence: Chemically synthesized oligonucleotide
ggccggaccctgggccttc

SEQ ID NO: 6199 - DNA, 19 bp, Artificial Sequence
  Description of Artificial Sequence: Chemically synthesized oligonucleotide
aaggcccagggtccggccc

SEQ ID NO: 6200 - DNA, 19 bp, Artificial Sequence
  Description of Artificial Sequence: Chemically synthesized oligonucleotide
gggccggaccctgggcctt

SEQ ID NO: 6201 - DNA, 19 bp, Artificial Sequence
  Description of Artificial Sequence: Chemically synthesized oligonucleotide
aggcccagggtccggccct

SEQ ID NO: 6202 - DNA, 19 bp, Artificial Sequence
  Description of Artificial Sequence: Chemically synthesized oligonucleotide
agggccggaccctgggcct

SEQ ID NO: 6203 - DNA, 19 bp, Artificial Sequence
  Description of Artificial Sequence: Chemically synthesized oligonucleotide
ggcccagggtccggccctg

SEQ ID NO: 6204 - DNA, 19 bp, Artificial Sequence
  Description of Artificial Sequence: Chemically synthesized oligonucleotide
cagggccggaccctgggcc

SEQ ID NO: 6205 - DNA, 19 bp, Artificial Sequence
  Description of Artificial Sequence: Chemically synthesized oligonucleotide
gcccagggtccggccctga

SEQ ID NO: 6206 - DNA, 19 bp, Artificial Sequence
  Description of Artificial Sequence: Chemically synthesized oligonucleotide
tcagggccggaccctgggc

SEQ ID NO: 6207 - DNA, 19 bp, Artificial Sequence
  Description of Artificial Sequence: Chemically synthesized oligonucleotide
cccagggtccggccctgac

SEQ ID NO: 6208 - DNA, 19 bp, Artificial Sequence
  Description of Artificial Sequence: Chemically synthesized oligonucleotide
gtcagggccggaccctggg

SEQ ID NO: 6209 - DNA, 19 bp, Artificial Sequence
  Description of Artificial Sequence: Chemically synthesized oligonucleotide
ccagggtccggccctgaca

SEQ ID NO: 6210 - DNA, 19 bp, Artificial Sequence
  Description of Artificial Sequence: Chemically synthesized oligonucleotide
tgtcagggccggaccctgg

SEQ ID NO: 6211 - DNA, 19 bp, Artificial Sequence
  Description of Artificial Sequence: Chemically synthesized oligonucleotide
cagggtccggccctgacag

SEQ ID NO: 6212 - DNA, 19 bp, Artificial Sequence
  Description of Artificial Sequence: Chemically synthesized oligonucleotide
ctgtcagggccggaccctg

SEQ ID NO: 6213 - DNA, 19 bp, Artificial Sequence
  Description of Artificial Sequence: Chemically synthesized oligonucleotide
agggtccggccctgacagc

SEQ ID NO: 6214 - DNA, 19 bp, Artificial Sequence
  Description of Artificial Sequence: Chemically synthesized oligonucleotide
gctgtcagggccggaccct

SEQ ID NO: 6215 - DNA, 19 bp, Artificial Sequence
  Description of Artificial Sequence: Chemically synthesized oligonucleotide
gggtccggccctgacagcc

SEQ ID NO: 6216 - DNA, 19 bp, Artificial Sequence
  Description of Artificial Sequence: Chemically synthesized oligonucleotide
ggctgtcagggccggaccc

SEQ ID NO: 6217 - DNA, 19 bp, Artificial Sequence
  Description of Artificial Sequence: Chemically synthesized oligonucleotide
ggtccggccctgacagccg

SEQ ID NO: 6218 - DNA, 19 bp, Artificial Sequence
  Description of Artificial Sequence: Chemically synthesized oligonucleotide
cggctgtcagggccggacc

SEQ ID NO: 6219 - DNA, 19 bp, Artificial Sequence
  Description of Artificial Sequence: Chemically synthesized oligonucleotide
gtccggccctgacagccgg

SEQ ID NO: 6220 - DNA, 19 bp, Artificial Sequence
  Description of Artificial Sequence: Chemically synthesized oligonucleotide
ccggctgtcagggccggac

SEQ ID NO: 6221 - DNA, 19 bp, Artificial Sequence
  Description of Artificial Sequence: Chemically synthesized oligonucleotide
tccggccctgacagccggc

SEQ ID NO: 6222 - DNA, 19 bp, Artificial Sequence
  Description of Artificial Sequence: Chemically synthesized oligonucleotide
gccggctgtcagggccgga

SEQ ID NO: 6223 - DNA, 19 bp, Artificial Sequence
  Description of Artificial Sequence: Chemically synthesized oligonucleotide
ccggccctgacagccggct

SEQ ID NO: 6224 - DNA, 19 bp, Artificial Sequence
  Description of Artificial Sequence: Chemically synthesized oligonucleotide
agccggctgtcagggccgg

SEQ ID NO: 6225 - DNA, 19 bp, Artificial Sequence
  Description of Artificial Sequence: Chemically synthesized oligonucleotide
cggccctgacagccggctc

SEQ ID NO: 6226 - DNA, 19 bp, Artificial Sequence
  Description of Artificial Sequence: Chemically synthesized oligonucleotide
gagccggctgtcagggccg

SEQ ID NO: 6227 - DNA, 19 bp, Artificial Sequence
  Description of Artificial Sequence: Chemically synthesized oligonucleotide
ggccctgacagccggctca

SEQ ID NO: 6228 - DNA, 19 bp, Artificial Sequence
  Description of Artificial Sequence: Chemically synthesized oligonucleotide
tgagccggctgtcagggcc

SEQ ID NO: 6229 - DNA, 19 bp, Artificial Sequence
  Description of Artificial Sequence: Chemically synthesized oligonucleotide
gccctgacagccggctcag

SEQ ID NO: 6230 - DNA, 19 bp, Artificial Sequence
  Description of Artificial Sequence: Chemically synthesized oligonucleotide
ctgagccggctgtcagggc

SEQ ID NO: 6231 - DNA, 19 bp, Artificial Sequence
  Description of Artificial Sequence: Chemically synthesized oligonucleotide
ccctgacagccggctcagc

SEQ ID NO: 6232 - DNA, 19 bp, Artificial Sequence
  Description of Artificial Sequence: Chemically synthesized oligonucleotide
gctgagccggctgtcaggg

SEQ ID NO: 6233 - DNA, 19 bp, Artificial Sequence
  Description of Artificial Sequence: Chemically synthesized oligonucleotide
cctgacagccggctcagca

SEQ ID NO: 6234 - DNA, 19 bp, Artificial Sequence
  Description of Artificial Sequence: Chemically synthesized oligonucleotide
tgctgagccggctgtcagg

SEQ ID NO: 6235 - DNA, 19 bp, Artificial Sequence
  Description of Artificial Sequence: Chemically synthesized oligonucleotide
ctgacagccggctcagcac

SEQ ID NO: 6236 - DNA, 19 bp, Artificial Sequence
  Description of Artificial Sequence: Chemically synthesized oligonucleotide
gtgctgagccggctgtcag

SEQ ID NO: 6237 - DNA, 19 bp, Artificial Sequence
  Description of Artificial Sequence: Chemically synthesized oligonucleotide
tgacagccggctcagcaca

SEQ ID NO: 6238 - DNA, 19 bp, Artificial Sequence
  Description of Artificial Sequence: Chemically synthesized oligonucleotide
tgtgctgagccggctgtca

SEQ ID NO: 6239 - DNA, 19 bp, Artificial Sequence
  Description of Artificial Sequence: Chemically synthesized oligonucleotide
gacagccggctcagcacag

SEQ ID NO: 6240 - DNA, 19 bp, Artificial Sequence
  Description of Artificial Sequence: Chemically synthesized oligonucleotide
ctgtgctgagccggctgtc

SEQ ID NO: 6241 - DNA, 19 bp, Artificial Sequence
  Description of Artificial Sequence: Chemically synthesized oligonucleotide
acagccggctcagcacagg

SEQ ID NO: 6242 - DNA, 19 bp, Artificial Sequence
  Description of Artificial Sequence: Chemically synthesized oligonucleotide
cctgtgctgagccggctgt

SEQ ID NO: 6243 - DNA, 19 bp, Artificial Sequence
  Description of Artificial Sequence: Chemically synthesized oligonucleotide
cagccggctcagcacaggc

SEQ ID NO: 6244 - DNA, 19 bp, Artificial Sequence
  Description of Artificial Sequence: Chemically synthesized oligonucleotide
gcctgtgctgagccggctg

SEQ ID NO: 6245 - DNA, 19 bp, Artificial Sequence
  Description of Artificial Sequence: Chemically synthesized oligonucleotide
agccggctcagcacaggcc

SEQ ID NO: 6246 - DNA, 19 bp, Artificial Sequence
  Description of Artificial Sequence: Chemically synthesized oligonucleotide
ggcctgtgctgagccggct

SEQ ID NO: 6247 - DNA, 19 bp, Artificial Sequence
  Description of Artificial Sequence: Chemically synthesized oligonucleotide
gccggctcagcacaggcct

SEQ ID NO: 6248 - DNA, 19 bp, Artificial Sequence
  Description of Artificial Sequence: Chemically synthesized oligonucleotide
aggcctgtgctgagccggc

SEQ ID NO: 6249 - DNA, 19 bp, Artificial Sequence
  Description of Artificial Sequence: Chemically synthesized oligonucleotide
ccggctcagcacaggcctc

SEQ ID NO: 6250 - DNA, 19 bp, Artificial Sequence
  Description of Artificial Sequence: Chemically synthesized oligonucleotide
gaggcctgtgctgagccgg

SEQ ID NO: 6251 - DNA, 19 bp, Artificial Sequence
  Description of Artificial Sequence: Chemically synthesized oligonucleotide
cggctcagcacaggcctcg

SEQ ID NO: 6252 - DNA, 19 bp, Artificial Sequence
  Description of Artificial Sequence: Chemically synthesized oligonucleotide
cgaggcctgtgctgagccg

SEQ ID NO: 6253 - DNA, 19 bp, Artificial Sequence
  Description of Artificial Sequence: Chemically synthesized oligonucleotide
ggctcagcacaggcctcgc

SEQ ID NO: 6254 - DNA, 19 bp, Artificial Sequence
  Description of Artificial Sequence: Chemically synthesized oligonucleotide
gcgaggcctgtgctgagcc

SEQ ID NO: 6255 - DNA, 19 bp, Artificial Sequence
  Description of Artificial Sequence: Chemically synthesized oligonucleotide
gctcagcacaggcctcgcc

SEQ ID NO: 6256 - DNA, 19 bp, Artificial Sequence
  Description of Artificial Sequence: Chemically synthesized oligonucleotide
ggcgaggcctgtgctgagc

SEQ ID NO: 6257 - DNA, 19 bp, Artificial Sequence
  Description of Artificial Sequence: Chemically synthesized oligonucleotide
ctcagcacaggcctcgcca

SEQ ID NO: 6258 - DNA, 19 bp, Artificial Sequence
  Description of Artificial Sequence: Chemically synthesized oligonucleotide
tggcgaggcctgtgctgag

SEQ ID NO: 6259 - DNA, 19 bp, Artificial Sequence
  Description of Artificial Sequence: Chemically synthesized oligonucleotide
tcagcacaggcctcgccaa

SEQ ID NO: 6260 - DNA, 19 bp, Artificial Sequence
  Description of Artificial Sequence: Chemically synthesized oligonucleotide
ttggcgaggcctgtgctga

SEQ ID NO: 6261 - DNA, 19 bp, Artificial Sequence
  Description of Artificial Sequence: Chemically synthesized oligonucleotide
cagcacaggcctcgccaag

SEQ ID NO: 6262 - DNA, 19 bp, Artificial Sequence
  Description of Artificial Sequence: Chemically synthesized oligonucleotide
cttggcgaggcctgtgctg

SEQ ID NO: 6263 - DNA, 19 bp, Artificial Sequence
  Description of Artificial Sequence: Chemically synthesized oligonucleotide
agcacaggcctcgccaagc

SEQ ID NO: 6264 - DNA, 19 bp, Artificial Sequence
  Description of Artificial Sequence: Chemically synthesized oligonucleotide
gcttggcgaggcctgtgct

SEQ ID NO: 6265 - DNA, 19 bp, Artificial Sequence
  Description of Artificial Sequence: Chemically synthesized oligonucleotide
gcacaggcctcgccaagca

SEQ ID NO: 6266 - DNA, 19 bp, Artificial Sequence
  Description of Artificial Sequence: Chemically synthesized oligonucleotide
tgcttggcgaggcctgtgc

SEQ ID NO: 6267 - DNA, 19 bp, Artificial Sequence
  Description of Artificial Sequence: Chemically synthesized oligonucleotide
cacaggcctcgccaagcac

SEQ ID NO: 6268 - DNA, 19 bp, Artificial Sequence
  Description of Artificial Sequence: Chemically synthesized oligonucleotide
gtgcttggcgaggcctgtg

SEQ ID NO: 6269 - DNA, 19 bp, Artificial Sequence
  Description of Artificial Sequence: Chemically synthesized oligonucleotide
acaggcctcgccaagcacc

SEQ ID NO: 6270 - DNA, 19 bp, Artificial Sequence
  Description of Artificial Sequence: Chemically synthesized oligonucleotide
ggtgcttggcgaggcctgt

SEQ ID NO: 6271 - DNA, 19 bp, Artificial Sequence
  Description of Artificial Sequence: Chemically synthesized oligonucleotide
caggcctcgccaagcacct

SEQ ID NO: 6272 - DNA, 19 bp, Artificial Sequence
  Description of Artificial Sequence: Chemically synthesized oligonucleotide
aggtgcttggcgaggcctg

SEQ ID NO: 6273 - DNA, 19 bp, Artificial Sequence
  Description of Artificial Sequence: Chemically synthesized oligonucleotide
aggcctcgccaagcacctg

SEQ ID NO: 6274 - DNA, 19 bp, Artificial Sequence
  Description of Artificial Sequence: Chemically synthesized oligonucleotide
caggtgcttggcgaggcct

SEQ ID NO: 6275 - DNA, 19 bp, Artificial Sequence
  Description of Artificial Sequence: Chemically synthesized oligonucleotide
ggcctcgccaagcacctgc

SEQ ID NO: 6276 - DNA, 19 bp, Artificial Sequence
  Description of Artificial Sequence: Chemically synthesized oligonucleotide
gcaggtgcttggcgaggcc

SEQ ID NO: 6277 - DNA, 19 bp, Artificial Sequence
  Description of Artificial Sequence: Chemically synthesized oligonucleotide
gcctcgccaagcacctgct

SEQ ID NO: 6278 - DNA, 19 bp, Artificial Sequence
  Description of Artificial Sequence: Chemically synthesized oligonucleotide
agcaggtgcttggcgaggc

SEQ ID NO: 6279 - DNA, 19 bp, Artificial Sequence
  Description of Artificial Sequence: Chemically synthesized oligonucleotide
cctcgccaagcacctgctc

SEQ ID NO: 6280 - DNA, 19 bp, Artificial Sequence
  Description of Artificial Sequence: Chemically synthesized oligonucleotide
gagcaggtgcttggcgagg

SEQ ID NO: 6281 - DNA, 19 bp, Artificial Sequence
  Description of Artificial Sequence: Chemically synthesized oligonucleotide
ctcgccaagcacctgctca

SEQ ID NO: 6282 - DNA, 19 bp, Artificial Sequence
  Description of Artificial Sequence: Chemically synthesized oligonucleotide
tgagcaggtgcttggcgag

SEQ ID NO: 6283 - DNA, 19 bp, Artificial Sequence
  Description of Artificial Sequence: Chemically synthesized oligonucleotide
tcgccaagcacctgctcag

SEQ ID NO: 6284 - DNA, 19 bp, Artificial Sequence
  Description of Artificial Sequence: Chemically synthesized oligonucleotide
ctgagcaggtgcttggcga

SEQ ID NO: 6285 - DNA, 19 bp, Artificial Sequence
  Description of Artificial Sequence: Chemically synthesized oligonucleotide
cgccaagcacctgctcagt

SEQ ID NO: 6286 - DNA, 19 bp, Artificial Sequence
  Description of Artificial Sequence: Chemically synthesized oligonucleotide
actgagcaggtgcttggcg

SEQ ID NO: 6287 - DNA, 19 bp, Artificial Sequence
  Description of Artificial Sequence: Chemically synthesized oligonucleotide
gccaagcacctgctcagtg

SEQ ID NO: 6288 - DNA, 19 bp, Artificial Sequence
  Description of Artificial Sequence: Chemically synthesized oligonucleotide
cactgagcaggtgcttggc

SEQ ID NO: 6289 - DNA, 19 bp, Artificial Sequence
  Description of Artificial Sequence: Chemically synthesized oligonucleotide
ccaagcacctgctcagtgg

SEQ ID NO: 6290 - DNA, 19 bp, Artificial Sequence
  Description of Artificial Sequence: Chemically synthesized oligonucleotide
ccactgagcaggtgcttgg

SEQ ID NO: 6291 - DNA, 19 bp, Artificial Sequence
  Description of Artificial Sequence: Chemically synthesized oligonucleotide
caagcacctgctcagtggt

SEQ ID NO: 6292 - DNA, 19 bp, Artificial Sequence
  Description of Artificial Sequence: Chemically synthesized oligonucleotide
accactgagcaggtgcttg

SEQ ID NO: 6293 - DNA, 19 bp, Artificial Sequence
  Description of Artificial Sequence: Chemically synthesized oligonucleotide
aagcacctgctcagtggtt

SEQ ID NO: 6294 - DNA, 19 bp, Artificial Sequence
  Description of Artificial Sequence: Chemically synthesized oligonucleotide
aaccactgagcaggtgctt

SEQ ID NO: 6295 - DNA, 19 bp, Artificial Sequence
  Description of Artificial Sequence: Chemically synthesized oligonucleotide
agcacctgctcagtggttt

SEQ ID NO: 6296 - DNA, 19 bp, Artificial Sequence
  Description of Artificial Sequence: Chemically synthesized oligonucleotide
aaaccactgagcaggtgct

SEQ ID NO: 6297 - DNA, 19 bp, Artificial Sequence
  Description of Artificial Sequence: Chemically synthesized oligonucleotide
gcacctgctcagtggtttg

SEQ ID NO: 6298 - DNA, 19 bp, Artificial Sequence
  Description of Artificial Sequence: Chemically synthesized oligonucleotide
caaaccactgagcaggtgc

SEQ ID NO: 6299 - DNA, 19 bp, Artificial Sequence
  Description of Artificial Sequence: Chemically synthesized oligonucleotide
cacctgctcagtggtttgg

SEQ ID NO: 6300 - DNA, 19 bp, Artificial Sequence
  Description of Artificial Sequence: Chemically synthesized oligonucleotide
ccaaaccactgagcaggtg

SEQ ID NO: 6301 - DNA, 19 bp, Artificial Sequence
  Description of Artificial Sequence: Chemically synthesized oligonucleotide
acctgctcagtggtttggg

SEQ ID NO: 6302 - DNA, 19 bp, Artificial Sequence
  Description of Artificial Sequence: Chemically synthesized oligonucleotide
cccaaaccactgagcaggt

SEQ ID NO: 6303 - DNA, 19 bp, Artificial Sequence
  Description of Artificial Sequence: Chemically synthesized oligonucleotide
cctgctcagtggtttgggg

SEQ ID NO: 6304 - DNA, 19 bp, Artificial Sequence
  Description of Artificial Sequence: Chemically synthesized oligonucleotide
ccccaaaccactgagcagg

SEQ ID NO: 6305 - DNA, 19 bp, Artificial Sequence
  Description of Artificial Sequence: Chemically synthesized oligonucleotide
ctgctcagtggtttggggg

SEQ ID NO: 6306 - DNA, 19 bp, Artificial Sequence
  Description of Artificial Sequence: Chemically synthesized oligonucleotide
cccccaaaccactgagcag

SEQ ID NO: 6307 - DNA, 19 bp, Artificial Sequence
  Description of Artificial Sequence: Chemically synthesized oligonucleotide
tgctcagtggtttggggga

SEQ ID NO: 6308 - DNA, 19 bp, Artificial Sequence
  Description of Artificial Sequence: Chemically synthesized oligonucleotide
tcccccaaaccactgagca

SEQ ID NO: 6309 - DNA, 19 bp, Artificial Sequence
  Description of Artificial Sequence: Chemically synthesized oligonucleotide
gctcagtggtttgggggac

SEQ ID NO: 6310 - DNA, 19 bp, Artificial Sequence
  Description of Artificial Sequence: Chemically synthesized oligonucleotide
gtcccccaaaccactgagc

SEQ ID NO: 6311 - DNA, 19 bp, Artificial Sequence
  Description of Artificial Sequence: Chemically synthesized oligonucleotide
ctcagtggtttgggggacc

SEQ ID NO: 6312 - DNA, 19 bp, Artificial Sequence
  Description of Artificial Sequence: Chemically synthesized oligonucleotide
ggtcccccaaaccactgag

SEQ ID NO: 6313 - DNA, 19 bp, Artificial Sequence
  Description of Artificial Sequence: Chemically synthesized oligonucleotide
tcagtggtttgggggaccg

SEQ ID NO: 6314 - DNA, 19 bp, Artificial Sequence
  Description of Artificial Sequence: Chemically synthesized oligonucleotide
cggtcccccaaaccactga

SEQ ID NO: 6315 - DNA, 19 bp, Artificial Sequence
  Description of Artificial Sequence: Chemically synthesized oligonucleotide
cagtggtttgggggaccga

SEQ ID NO: 6316 - DNA, 19 bp, Artificial Sequence
  Description of Artificial Sequence: Chemically synthesized oligonucleotide
tcggtcccccaaaccactg

SEQ ID NO: 6317 - DNA, 19 bp, Artificial Sequence
  Description of Artificial Sequence: Chemically synthesized oligonucleotide
agtggtttgggggaccgac

SEQ ID NO: 6318 - DNA, 19 bp, Artificial Sequence
  Description of Artificial Sequence: Chemically synthesized oligonucleotide
gtcggtcccccaaaccact

SEQ ID NO: 6319 - DNA, 19 bp, Artificial Sequence
  Description of Artificial Sequence: Chemically synthesized oligonucleotide
gtggtttgggggaccgact

SEQ ID NO: 6320 - DNA, 19 bp, Artificial Sequence
  Description of Artificial Sequence: Chemically synthesized oligonucleotide
agtcggtcccccaaaccac

SEQ ID NO: 6321 - DNA, 19 bp, Artificial Sequence
  Description of Artificial Sequence: Chemically synthesized oligonucleotide
tggtttgggggaccgactg

SEQ ID NO: 6322 - DNA, 19 bp, Artificial Sequence
  Description of Artificial Sequence: Chemically synthesized oligonucleotide
cagtcggtcccccaaacca

SEQ ID NO: 6323 - DNA, 19 bp, Artificial Sequence
  Description of Artificial Sequence: Chemically synthesized oligonucleotide
ggtttgggggaccgactgt

SEQ ID NO: 6324 - DNA, 19 bp, Artificial Sequence
  Description of Artificial Sequence: Chemically synthesized oligonucleotide
acagtcggtcccccaaacc

SEQ ID NO: 6325 - DNA, 19 bp, Artificial Sequence
  Description of Artificial Sequence: Chemically synthesized oligonucleotide
gtttgggggaccgactgtg

SEQ ID NO: 6326 - DNA, 19 bp, Artificial Sequence
  Description of Artificial Sequence: Chemically synthesized oligonucleotide
cacagtcggtcccccaaac

SEQ ID NO: 6327 - DNA, 19 bp, Artificial Sequence
  Description of Artificial Sequence: Chemically synthesized oligonucleotide
tttgggggaccgactgtgc

SEQ ID NO: 6328 - DNA, 19 bp, Artificial Sequence
  Description of Artificial Sequence: Chemically synthesized oligonucleotide
gcacagtcggtcccccaaa

SEQ ID NO: 6329 - DNA, 19 bp, Artificial Sequence
  Description of Artificial Sequence: Chemically synthesized oligonucleotide
ttgggggaccgactgtgcc

SEQ ID NO: 6330 - DNA, 19 bp, Artificial Sequence
  Description of Artificial Sequence: Chemically synthesized oligonucleotide
ggcacagtcggtcccccaa

SEQ ID NO: 6331 - DNA, 19 bp, Artificial Sequence
  Description of Artificial Sequence: Chemically synthesized oligonucleotide
tgggggaccgactgtgccg

SEQ ID NO: 6332 - DNA, 19 bp, Artificial Sequence
  Description of Artificial Sequence: Chemically synthesized oligonucleotide
cggcacagtcggtccccca

SEQ ID NO: 6333 - DNA, 19 bp, Artificial Sequence
  Description of Artificial Sequence: Chemically synthesized oligonucleotide
gggggaccgactgtgccgc

SEQ ID NO: 6334 - DNA, 19 bp, Artificial Sequence
  Description of Artificial Sequence: Chemically synthesized oligonucleotide
gcggcacagtcggtccccc

SEQ ID NO: 6335 - DNA, 19 bp, Artificial Sequence
  Description of Artificial Sequence: Chemically synthesized oligonucleotide
ggggaccgactgtgccgcc

SEQ ID NO: 6336 - DNA, 19 bp, Artificial Sequence
  Description of Artificial Sequence: Chemically synthesized oligonucleotide
ggcggcacagtcggtcccc

SEQ ID NO: 6337 - DNA, 19 bp, Artificial Sequence
  Description of Artificial Sequence: Chemically synthesized oligonucleotide
gggaccgactgtgccgcct

SEQ ID NO: 6338 - DNA, 19 bp, Artificial Sequence
  Description of Artificial Sequence: Chemically synthesized oligonucleotide
aggcggcacagtcggtccc

SEQ ID NO: 6339 - DNA, 19 bp, Artificial Sequence
  Description of Artificial Sequence: Chemically synthesized oligonucleotide
ggaccgactgtgccgcctg

SEQ ID NO: 6340 - DNA, 19 bp, Artificial Sequence
  Description of Artificial Sequence: Chemically synthesized oligonucleotide
caggcggcacagtcggtcc

SEQ ID NO: 6341 - DNA, 19 bp, Artificial Sequence
  Description of Artificial Sequence: Chemically synthesized oligonucleotide
gaccgactgtgccgcctgc

SEQ ID NO: 6342 - DNA, 19 bp, Artificial Sequence
  Description of Artificial Sequence: Chemically synthesized oligonucleotide
gcaggcggcacagtcggtc

SEQ ID NO: 6343 - DNA, 19 bp, Artificial Sequence
  Description of Artificial Sequence: Chemically synthesized oligonucleotide
accgactgtgccgcctgct

SEQ ID NO: 6344 - DNA, 19 bp, Artificial Sequence
  Description of Artificial Sequence: Chemically synthesized oligonucleotide
agcaggcggcacagtcggt

SEQ ID NO: 6345 - DNA, 19 bp, Artificial Sequence
  Description of Artificial Sequence: Chemically synthesized oligonucleotide
ccgactgtgccgcctgctg

SEQ ID NO: 6346 - DNA, 19 bp, Artificial Sequence
  Description of Artificial Sequence: Chemically synthesized oligonucleotide
cagcaggcggcacagtcgg

SEQ ID NO: 6347 - DNA, 19 bp, Artificial Sequence
  Description of Artificial Sequence: Chemically synthesized oligonucleotide
cgactgtgccgcctgctgc

SEQ ID NO: 6348 - DNA, 19 bp, Artificial Sequence
  Description of Artificial Sequence: Chemically synthesized oligonucleotide
gcagcaggcggcacagtcg

SEQ ID NO: 6349 - DNA, 19 bp, Artificial Sequence
  Description of Artificial Sequence: Chemically synthesized oligonucleotide
gactgtgccgcctgctgcg

SEQ ID NO: 6350 - DNA, 19 bp, Artificial Sequence
  Description of Artificial Sequence: Chemically synthesized oligonucleotide
cgcagcaggcggcacagtc

SEQ ID NO: 6351 - DNA, 19 bp, Artificial Sequence
  Description of Artificial Sequence: Chemically synthesized oligonucleotide
actgtgccgcctgctgcgg

SEQ ID NO: 6352 - DNA, 19 bp, Artificial Sequence
  Description of Artificial Sequence: Chemically synthesized oligonucleotide
ccgcagcaggcggcacagt

SEQ ID NO: 6353 - DNA, 19 bp, Artificial Sequence
  Description of Artificial Sequence: Chemically synthesized oligonucleotide
ctgtgccgcctgctgcgga

SEQ ID NO: 6354 - DNA, 19 bp, Artificial Sequence
  Description of Artificial Sequence: Chemically synthesized oligonucleotide
tccgcagcaggcggcacag

SEQ ID NO: 6355 - DNA, 19 bp, Artificial Sequence
  Description of Artificial Sequence: Chemically synthesized oligonucleotide
tgtgccgcctgctgcggag

SEQ ID NO: 6356 - DNA, 19 bp, Artificial Sequence
  Description of Artificial Sequence: Chemically synthesized oligonucleotide
ctccgcagcaggcggcaca

SEQ ID NO: 6357 - DNA, 19 bp, Artificial Sequence
  Description of Artificial Sequence: Chemically synthesized oligonucleotide
gtgccgcctgctgcggagg

SEQ ID NO: 6358 - DNA, 19 bp, Artificial Sequence
  Description of Artificial Sequence: Chemically synthesized oligonucleotide
cctccgcagcaggcggcac

SEQ ID NO: 6359 - DNA, 19 bp, Artificial Sequence
  Description of Artificial Sequence: Chemically synthesized oligonucleotide
tgccgcctgctgcggaggg

SEQ ID NO: 6360 - DNA, 19 bp, Artificial Sequence
  Description of Artificial Sequence: Chemically synthesized oligonucleotide
ccctccgcagcaggcggca

SEQ ID NO: 6361 - DNA, 19 bp, Artificial Sequence
  Description of Artificial Sequence: Chemically synthesized oligonucleotide
gccgcctgctgcggaggga

SEQ ID NO: 6362 - DNA, 19 bp, Artificial Sequence
  Description of Artificial Sequence: Chemically synthesized oligonucleotide
tccctccgcagcaggcggc

SEQ ID NO: 6363 - DNA, 19 bp, Artificial Sequence
  Description of Artificial Sequence: Chemically synthesized oligonucleotide
ccgcctgctgcggagggag

SEQ ID NO: 6364 - DNA, 19 bp, Artificial Sequence
  Description of Artificial Sequence: Chemically synthesized oligonucleotide
ctccctccgcagcaggcgg

SEQ ID NO: 6365 - DNA, 19 bp, Artificial Sequence
  Description of Artificial Sequence: Chemically synthesized oligonucleotide
cgcctgctgcggagggagc

SEQ ID NO: 6366 - DNA, 19 bp, Artificial Sequence
  Description of Artificial Sequence: Chemically synthesized oligonucleotide
gctccctccgcagcaggcg

SEQ ID NO: 6367 - DNA, 19 bp, Artificial Sequence
  Description of Artificial Sequence: Chemically synthesized oligonucleotide
gcctgctgcggagggagcg

SEQ ID NO: 6368 - DNA, 19 bp, Artificial Sequence
  Description of Artificial Sequence: Chemically synthesized oligonucleotide
cgctccctccgcagcaggc

SEQ ID NO: 6369 - DNA, 19 bp, Artificial Sequence
  Description of Artificial Sequence: Chemically synthesized oligonucleotide
cctgctgcggagggagcgg

SEQ ID NO: 6370 - DNA, 19 bp, Artificial Sequence
  Description of Artificial Sequence: Chemically synthesized oligonucleotide
ccgctccctccgcagcagg

SEQ ID NO: 6371 - DNA, 19 bp, Artificial Sequence
  Description of Artificial Sequence: Chemically synthesized oligonucleotide
ctgctgcggagggagcggg

SEQ ID NO: 6372 - DNA, 19 bp, Artificial Sequence
  Description of Artificial Sequence: Chemically synthesized oligonucleotide
cccgctccctccgcagcag

SEQ ID NO: 6373 - DNA, 19 bp, Artificial Sequence
  Description of Artificial Sequence: Chemically synthesized oligonucleotide
tgctgcggagggagcggga

SEQ ID NO: 6374 - DNA, 19 bp, Artificial Sequence
  Description of Artificial Sequence: Chemically synthesized oligonucleotide
tcccgctccctccgcagca

SEQ ID NO: 6375 - DNA, 19 bp, Artificial Sequence
  Description of Artificial Sequence: Chemically synthesized oligonucleotide
gctgcggagggagcgggag

SEQ ID NO: 6376 - DNA, 19 bp, Artificial Sequence
  Description of Artificial Sequence: Chemically synthesized oligonucleotide
ctcccgctccctccgcagc

SEQ ID NO: 6377 - DNA, 19 bp, Artificial Sequence
  Description of Artificial Sequence: Chemically synthesized oligonucleotide
ctgcggagggagcgggagg

SEQ ID NO: 6378 - DNA, 19 bp, Artificial Sequence
  Description of Artificial Sequence: Chemically synthesized oligonucleotide
cctcccgctccctccgcag

SEQ ID NO: 6379 - DNA, 19 bp, Artificial Sequence
  Description of Artificial Sequence: Chemically synthesized oligonucleotide
tgcggagggagcgggaggc

SEQ ID NO: 6380 - DNA, 19 bp, Artificial Sequence
  Description of Artificial Sequence: Chemically synthesized oligonucleotide
gcctcccgctccctccgca

SEQ ID NO: 6381 - DNA, 19 bp, Artificial Sequence
  Description of Artificial Sequence: Chemically synthesized oligonucleotide
gcggagggagcgggaggcc

SEQ ID NO: 6382 - DNA, 19 bp, Artificial Sequence
  Description of Artificial Sequence: Chemically synthesized oligonucleotide
ggcctcccgctccctccgc

SEQ ID NO: 6383 - DNA, 19 bp, Artificial Sequence
  Description of Artificial Sequence: Chemically synthesized oligonucleotide
cggagggagcgggaggccc

SEQ ID NO: 6384 - DNA, 19 bp, Artificial Sequence
  Description of Artificial Sequence: Chemically synthesized oligonucleotide
gggcctcccgctccctccg

SEQ ID NO: 6385 - DNA, 19 bp, Artificial Sequence
  Description of Artificial Sequence: Chemically synthesized oligonucleotide
ggagggagcgggaggccct

SEQ ID NO: 6386 - DNA, 19 bp, Artificial Sequence
  Description of Artificial Sequence: Chemically synthesized oligonucleotide
agggcctcccgctccctcc

SEQ ID NO: 6387 - DNA, 19 bp, Artificial Sequence
  Description of Artificial Sequence: Chemically synthesized oligonucleotide
gagggagcgggaggccctg

SEQ ID NO: 6388 - DNA, 19 bp, Artificial Sequence
  Description of Artificial Sequence: Chemically synthesized oligonucleotide
cagggcctcccgctccctc

SEQ ID NO: 6389 - DNA, 19 bp, Artificial Sequence
  Description of Artificial Sequence: Chemically synthesized oligonucleotide
agggagcgggaggccctgg

SEQ ID NO: 6390 - DNA, 19 bp, Artificial Sequence
  Description of Artificial Sequence: Chemically synthesized oligonucleotide
ccagggcctcccgctccct

SEQ ID NO: 6391 - DNA, 19 bp, Artificial Sequence
  Description of Artificial Sequence: Chemically synthesized oligonucleotide
gggagcgggaggccctggc

SEQ ID NO: 6392 - DNA, 19 bp, Artificial Sequence
  Description of Artificial Sequence: Chemically synthesized oligonucleotide
gccagggcctcccgctccc

SEQ ID NO: 6393 - DNA, 19 bp, Artificial Sequence
  Description of Artificial Sequence: Chemically synthesized oligonucleotide
ggagcgggaggccctggct

SEQ ID NO: 6394 - DNA, 19 bp, Artificial Sequence
  Description of Artificial Sequence: Chemically synthesized oligonucleotide
agccagggcctcccgctcc

SEQ ID NO: 6395 - DNA, 19 bp, Artificial Sequence
  Description of Artificial Sequence: Chemically synthesized oligonucleotide
gagcgggaggccctggctt

SEQ ID NO: 6396 - DNA, 19 bp, Artificial Sequence
  Description of Artificial Sequence: Chemically synthesized oligonucleotide
aagccagggcctcccgctc

SEQ ID NO: 6397 - DNA, 19 bp, Artificial Sequence
  Description of Artificial Sequence: Chemically synthesized oligonucleotide
agcgggaggccctggcttg

SEQ ID NO: 6398 - DNA, 19 bp, Artificial Sequence
  Description of Artificial Sequence: Chemically synthesized oligonucleotide
caagccagggcctcccgct

SEQ ID NO: 6399 - DNA, 19 bp, Artificial Sequence
  Description of Artificial Sequence: Chemically synthesized oligonucleotide
gcgggaggccctggcttgg

SEQ ID NO: 6400 - DNA, 19 bp, Artificial Sequence
  Description of Artificial Sequence: Chemically synthesized oligonucleotide
ccaagccagggcctcccgc

SEQ ID NO: 6401 - DNA, 19 bp, Artificial Sequence
  Description of Artificial Sequence: Chemically synthesized oligonucleotide
cgggaggccctggcttggg

SEQ ID NO: 6402 - DNA, 19 bp, Artificial Sequence
  Description of Artificial Sequence: Chemically synthesized oligonucleotide
cccaagccagggcctcccg

SEQ ID NO: 6403 - DNA, 19 bp, Artificial Sequence
  Description of Artificial Sequence: Chemically synthesized oligonucleotide
gggaggccctggcttgggc

SEQ ID NO: 6404 - DNA, 19 bp, Artificial Sequence
  Description of Artificial Sequence: Chemically synthesized oligonucleotide
gcccaagccagggcctccc

SEQ ID NO: 6405 - DNA, 19 bp, Artificial Sequence
  Description of Artificial Sequence: Chemically synthesized oligonucleotide
ggaggccctggcttgggcc

SEQ ID NO: 6406 - DNA, 19 bp, Artificial Sequence
  Description of Artificial Sequence: Chemically synthesized oligonucleotide
ggcccaagccagggcctcc

SEQ ID NO: 6407 - DNA, 19 bp, Artificial Sequence
  Description of Artificial Sequence: Chemically synthesized oligonucleotide
gaggccctggcttgggccc

SEQ ID NO: 6408 - DNA, 19 bp, Artificial Sequence
  Description of Artificial Sequence: Chemically synthesized oligonucleotide
gggcccaagccagggcctc

SEQ ID NO: 6409 - DNA, 19 bp, Artificial Sequence
  Description of Artificial Sequence: Chemically synthesized oligonucleotide
aggccctggcttgggccca

SEQ ID NO: 6410 - DNA, 19 bp, Artificial Sequence
  Description of Artificial Sequence: Chemically synthesized oligonucleotide
tgggcccaagccagggcct

SEQ ID NO: 6411 - DNA, 19 bp, Artificial Sequence
  Description of Artificial Sequence: Chemically synthesized oligonucleotide
ggccctggcttgggcccag

SEQ ID NO: 6412 - DNA, 19 bp, Artificial Sequence
  Description of Artificial Sequence: Chemically synthesized oligonucleotide
ctgggcccaagccagggcc

SEQ ID NO: 6413 - DNA, 19 bp, Artificial Sequence
  Description of Artificial Sequence: Chemically synthesized oligonucleotide
gccctggcttgggcccagc

SEQ ID NO: 6414 - DNA, 19 bp, Artificial Sequence
  Description of Artificial Sequence: Chemically synthesized oligonucleotide
gctgggcccaagccagggc

SEQ ID NO: 6415 - DNA, 19 bp, Artificial Sequence
  Description of Artificial Sequence: Chemically synthesized oligonucleotide
ccctggcttgggcccagcg

SEQ ID NO: 6416 - DNA, 19 bp, Artificial Sequence
  Description of Artificial Sequence: Chemically synthesized oligonucleotide
cgctgggcccaagccaggg

SEQ ID NO: 6417 - DNA, 19 bp, Artificial Sequence
  Description of Artificial Sequence: Chemically synthesized oligonucleotide
cctggcttgggcccagcgg

SEQ ID NO: 6418 - DNA, 19 bp, Artificial Sequence
  Description of Artificial Sequence: Chemically synthesized oligonucleotide
ccgctgggcccaagccagg

SEQ ID NO: 6419 - DNA, 19 bp, Artificial Sequence
  Description of Artificial Sequence: Chemically synthesized oligonucleotide
ctggcttgggcccagcggg

SEQ ID NO: 6420 - DNA, 19 bp, Artificial Sequence
  Description of Artificial Sequence: Chemically synthesized oligonucleotide
cccgctgggcccaagccag

SEQ ID NO: 6421 - DNA, 19 bp, Artificial Sequence
  Description of Artificial Sequence: Chemically synthesized oligonucleotide
tggcttgggcccagcggga

SEQ ID NO: 6422 - DNA, 19 bp, Artificial Sequence
  Description of Artificial Sequence: Chemically synthesized oligonucleotide
tcccgctgggcccaagcca

SEQ ID NO: 6423 - DNA, 19 bp, Artificial Sequence
  Description of Artificial Sequence: Chemically synthesized oligonucleotide
ggcttgggcccagcgggaa

SEQ ID NO: 6424 - DNA, 19 bp, Artificial Sequence
  Description of Artificial Sequence: Chemically synthesized oligonucleotide
ttcccgctgggcccaagcc

SEQ ID NO: 6425 - DNA, 19 bp, Artificial Sequence
  Description of Artificial Sequence: Chemically synthesized oligonucleotide
gcttgggcccagcgggaag

SEQ ID NO: 6426 - DNA, 19 bp, Artificial Sequence
  Description of Artificial Sequence: Chemically synthesized oligonucleotide
cttcccgctgggcccaagc

SEQ ID NO: 6427 - DNA, 19 bp, Artificial Sequence
  Description of Artificial Sequence: Chemically synthesized oligonucleotide
cttgggcccagcgggaagg

SEQ ID NO: 6428 - DNA, 19 bp, Artificial Sequence
  Description of Artificial Sequence: Chemically synthesized oligonucleotide
ccttcccgctgggcccaag

SEQ ID NO: 6429 - DNA, 19 bp, Artificial Sequence
  Description of Artificial Sequence: Chemically synthesized oligonucleotide
ttgggcccagcgggaaggc

SEQ ID NO: 6430 - DNA, 19 bp, Artificial Sequence
  Description of Artificial Sequence: Chemically synthesized oligonucleotide
gccttcccgctgggcccaa

SEQ ID NO: 6431 - DNA, 19 bp, Artificial Sequence
  Description of Artificial Sequence: Chemically synthesized oligonucleotide
tgggcccagcgggaaggcc

SEQ ID NO: 6432 - DNA, 19 bp, Artificial Sequence
  Description of Artificial Sequence: Chemically synthesized oligonucleotide
ggccttcccgctgggccca

SEQ ID NO: 6433 - DNA, 19 bp, Artificial Sequence
  Description of Artificial Sequence: Chemically synthesized oligonucleotide
gggcccagcgggaaggcca

SEQ ID NO: 6434 - DNA, 19 bp, Artificial Sequence
  Description of Artificial Sequence: Chemically synthesized oligonucleotide
tggccttcccgctgggccc

SEQ ID NO: 6435 - DNA, 19 bp, Artificial Sequence
  Description of Artificial Sequence: Chemically synthesized oligonucleotide
ggcccagcgggaaggccaa

SEQ ID NO: 6436 - DNA, 19 bp, Artificial Sequence
  Description of Artificial Sequence: Chemically synthesized oligonucleotide
ttggccttcccgctgggcc

SEQ ID NO: 6437 - DNA, 19 bp, Artificial Sequence
  Description of Artificial Sequence: Chemically synthesized oligonucleotide
gcccagcgggaaggccaag

SEQ ID NO: 6438 - DNA, 19 bp, Artificial Sequence
  Description of Artificial Sequence: Chemically synthesized oligonucleotide
cttggccttcccgctgggc

SEQ ID NO: 6439 - DNA, 19 bp, Artificial Sequence
  Description of Artificial Sequence: Chemically synthesized oligonucleotide
cccagcgggaaggccaagg

SEQ ID NO: 6440 - DNA, 19 bp, Artificial Sequence
  Description of Artificial Sequence: Chemically synthesized oligonucleotide
ccttggccttcccgctggg

SEQ ID NO: 6441 - DNA, 19 bp, Artificial Sequence
  Description of Artificial Sequence: Chemically synthesized oligonucleotide
ccagcgggaaggccaaggg

SEQ ID NO: 6442 - DNA, 19 bp, Artificial Sequence
  Description of Artificial Sequence: Chemically synthesized oligonucleotide
cccttggccttcccgctgg

SEQ ID NO: 6443 - DNA, 19 bp, Artificial Sequence
  Description of Artificial Sequence: Chemically synthesized oligonucleotide
cagcgggaaggccaagggc

SEQ ID NO: 6444 - DNA, 19 bp, Artificial Sequence
  Description of Artificial Sequence: Chemically synthesized oligonucleotide
gcccttggccttcccgctg

SEQ ID NO: 6445 - DNA, 19 bp, Artificial Sequence
  Description of Artificial Sequence: Chemically synthesized oligonucleotide
agcgggaaggccaagggcc

SEQ ID NO: 6446 - DNA, 19 bp, Artificial Sequence
  Description of Artificial Sequence: Chemically synthesized oligonucleotide
ggcccttggccttcccgct

SEQ ID NO: 6447 - DNA, 19 bp, Artificial Sequence
  Description of Artificial Sequence: Chemically synthesized oligonucleotide
gcgggaaggccaagggcca

SEQ ID NO: 6448 - DNA, 19 bp, Artificial Sequence
  Description of Artificial Sequence: Chemically synthesized oligonucleotide
tggcccttggccttcccgc

SEQ ID NO: 6449 - DNA, 19 bp, Artificial Sequence
  Description of Artificial Sequence: Chemically synthesized oligonucleotide
cgggaaggccaagggccag

SEQ ID NO: 6450 - DNA, 19 bp, Artificial Sequence
  Description of Artificial Sequence: Chemically synthesized oligonucleotide
ctggcccttggccttcccg

SEQ ID NO: 6451 - DNA, 19 bp, Artificial Sequence
  Description of Artificial Sequence: Chemically synthesized oligonucleotide
gggaaggccaagggccagc

SEQ ID NO: 6452 - DNA, 19 bp, Artificial Sequence
  Description of Artificial Sequence: Chemically synthesized oligonucleotide
gctggcccttggccttccc

SEQ ID NO: 6453 - DNA, 19 bp, Artificial Sequence
  Description of Artificial Sequence: Chemically synthesized oligonucleotide
ggaaggccaagggccagcc

SEQ ID NO: 6454 - DNA, 19 bp, Artificial Sequence
  Description of Artificial Sequence: Chemically synthesized oligonucleotide
ggctggcccttggccttcc

SEQ ID NO: 6455 - DNA, 19 bp, Artificial Sequence
  Description of Artificial Sequence: Chemically synthesized oligonucleotide
gaaggccaagggccagccg

SEQ ID NO: 6456 - DNA, 19 bp, Artificial Sequence
  Description of Artificial Sequence: Chemically synthesized oligonucleotide
cggctggcccttggccttc

SEQ ID NO: 6457 - DNA, 19 bp, Artificial Sequence
  Description of Artificial Sequence: Chemically synthesized oligonucleotide
aaggccaagggccagccgt

SEQ ID NO: 6458 - DNA, 19 bp, Artificial Sequence
  Description of Artificial Sequence: Chemically synthesized oligonucleotide
acggctggcccttggcctt

SEQ ID NO: 6459 - DNA, 19 bp, Artificial Sequence
  Description of Artificial Sequence: Chemically synthesized oligonucleotide
aggccaagggccagccgtg

SEQ ID NO: 6460 - DNA, 19 bp, Artificial Sequence
  Description of Artificial Sequence: Chemically synthesized oligonucleotide
cacggctggcccttggcct

SEQ ID NO: 6461 - DNA, 19 bp, Artificial Sequence
  Description of Artificial Sequence: Chemically synthesized oligonucleotide
ggccaagggccagccgtga

SEQ ID NO: 6462 - DNA, 19 bp, Artificial Sequence
  Description of Artificial Sequence: Chemically synthesized oligonucleotide
tcacggctggcccttggcc

SEQ ID NO: 6463 - DNA, 19 bp, Artificial Sequence
  Description of Artificial Sequence: Chemically synthesized oligonucleotide
gccaagggccagccgtgac

SEQ ID NO: 6464 - DNA, 19 bp, Artificial Sequence
  Description of Artificial Sequence: Chemically synthesized oligonucleotide
gtcacggctggcccttggc

SEQ ID NO: 6465 - DNA, 19 bp, Artificial Sequence
  Description of Artificial Sequence: Chemically synthesized oligonucleotide
ccaagggccagccgtgaca

SEQ ID NO: 6466 - DNA, 19 bp, Artificial Sequence
  Description of Artificial Sequence: Chemically synthesized oligonucleotide
tgtcacggctggcccttgg

SEQ ID NO: 6467 - DNA, 19 bp, Artificial Sequence
  Description of Artificial Sequence: Chemically synthesized oligonucleotide
caagggccagccgtgacag

SEQ ID NO: 6468 - DNA, 19 bp, Artificial Sequence
  Description of Artificial Sequence: Chemically synthesized oligonucleotide
ctgtcacggctggcccttg

SEQ ID NO: 6469 - DNA, 19 bp, Artificial Sequence
  Description of Artificial Sequence: Chemically synthesized oligonucleotide
aagggccagccgtgacaga

SEQ ID NO: 6470 - DNA, 19 bp, Artificial Sequence
  Description of Artificial Sequence: Chemically synthesized oligonucleotide
tctgtcacggctggccctt

SEQ ID NO: 6471 - DNA, 19 bp, Artificial Sequence
  Description of Artificial Sequence: Chemically synthesized oligonucleotide
agggccagccgtgacagag

SEQ ID NO: 6472 - DNA, 19 bp, Artificial Sequence
  Description of Artificial Sequence: Chemically synthesized oligonucleotide
ctctgtcacggctggccct

SEQ ID NO: 6473 - DNA, 19 bp, Artificial Sequence
  Description of Artificial Sequence: Chemically synthesized oligonucleotide
gggccagccgtgacagagg

SEQ ID NO: 6474 - DNA, 19 bp, Artificial Sequence
  Description of Artificial Sequence: Chemically synthesized oligonucleotide
cctctgtcacggctggccc

SEQ ID NO: 6475 - DNA, 19 bp, Artificial Sequence
  Description of Artificial Sequence: Chemically synthesized oligonucleotide
ggccagccgtgacagagga

SEQ ID NO: 6476 - DNA, 19 bp, Artificial Sequence
  Description of Artificial Sequence: Chemically synthesized oligonucleotide
tcctctgtcacggctggcc

SEQ ID NO: 6477 - DNA, 19 bp, Artificial Sequence
  Description of Artificial Sequence: Chemically synthesized oligonucleotide
gccagccgtgacagaggac

SEQ ID NO: 6478 - DNA, 19 bp, Artificial Sequence
  Description of Artificial Sequence: Chemically synthesized oligonucleotide
gtcctctgtcacggctggc

SEQ ID NO: 6479 - DNA, 19 bp, Artificial Sequence
  Description of Artificial Sequence: Chemically synthesized oligonucleotide
ccagccgtgacagaggaca

SEQ ID NO: 6480 - DNA, 19 bp, Artificial Sequence
  Description of Artificial Sequence: Chemically synthesized oligonucleotide
tgtcctctgtcacggctgg

SEQ ID NO: 6481 - DNA, 19 bp, Artificial Sequence
  Description of Artificial Sequence: Chemically synthesized oligonucleotide
cagccgtgacagaggacag

SEQ ID NO: 6482 - DNA, 19 bp, Artificial Sequence
  Description of Artificial Sequence: Chemically synthesized oligonucleotide
ctgtcctctgtcacggctg

SEQ ID NO: 6483 - DNA, 19 bp, Artificial Sequence
  Description of Artificial Sequence: Chemically synthesized oligonucleotide
agccgtgacagaggacagc

SEQ ID NO: 6484 - DNA, 19 bp, Artificial Sequence
  Description of Artificial Sequence: Chemically synthesized oligonucleotide
gctgtcctctgtcacggct

SEQ ID NO: 6485 - DNA, 19 bp, Artificial Sequence
  Description of Artificial Sequence: Chemically synthesized oligonucleotide
gccgtgacagaggacagcc

SEQ ID NO: 6486 - DNA, 19 bp, Artificial Sequence
  Description of Artificial Sequence: Chemically synthesized oligonucleotide
ggctgtcctctgtcacggc

SEQ ID NO: 6487 - DNA, 19 bp, Artificial Sequence
  Description of Artificial Sequence: Chemically synthesized oligonucleotide
ccgtgacagaggacagccc

SEQ ID NO: 6488 - DNA, 19 bp, Artificial Sequence
  Description of Artificial Sequence: Chemically synthesized oligonucleotide
gggctgtcctctgtcacgg

SEQ ID NO: 6489 - DNA, 19 bp, Artificial Sequence
  Description of Artificial Sequence: Chemically synthesized oligonucleotide
cgtgacagaggacagccca

SEQ ID NO: 6490 - DNA, 19 bp, Artificial Sequence
  Description of Artificial Sequence: Chemically synthesized oligonucleotide
tgggctgtcctctgtcacg

SEQ ID NO: 6491 - DNA, 19 bp, Artificial Sequence
  Description of Artificial Sequence: Chemically synthesized oligonucleotide
gtgacagaggacagcccag

SEQ ID NO: 6492 - DNA, 19 bp, Artificial Sequence
  Description of Artificial Sequence: Chemically synthesized oligonucleotide
ctgggctgtcctctgtcac

SEQ ID NO: 6493 - DNA, 19 bp, Artificial Sequence
  Description of Artificial Sequence: Chemically synthesized oligonucleotide
tgacagaggacagcccagg

SEQ ID NO: 6494 - DNA, 19 bp, Artificial Sequence
  Description of Artificial Sequence: Chemically synthesized oligonucleotide
cctgggctgtcctctgtca

SEQ ID NO: 6495 - DNA, 19 bp, Artificial Sequence
  Description of Artificial Sequence: Chemically synthesized oligonucleotide
gacagaggacagcccaggc

SEQ ID NO: 6496 - DNA, 19 bp, Artificial Sequence
  Description of Artificial Sequence: Chemically synthesized oligonucleotide
gcctgggctgtcctctgtc

SEQ ID NO: 6497 - DNA, 19 bp, Artificial Sequence
  Description of Artificial Sequence: Chemically synthesized oligonucleotide
acagaggacagcccaggca

SEQ ID NO: 6498 - DNA, 19 bp, Artificial Sequence
  Description of Artificial Sequence: Chemically synthesized oligonucleotide
tgcctgggctgtcctctgt

SEQ ID NO: 6499 - DNA, 19 bp, Artificial Sequence
  Description of Artificial Sequence: Chemically synthesized oligonucleotide
cagaggacagcccaggcat

SEQ ID NO: 6500 - DNA, 19 bp, Artificial Sequence
  Description of Artificial Sequence: Chemically synthesized oligonucleotide
atgcctgggctgtcctctg

SEQ ID NO: 6501 - DNA, 19 bp, Artificial Sequence
  Description of Artificial Sequence: Chemically synthesized oligonucleotide
agaggacagcccaggcatt

SEQ ID NO: 6502 - DNA, 19 bp, Artificial Sequence
  Description of Artificial Sequence: Chemically synthesized oligonucleotide
aatgcctgggctgtcctct

SEQ ID NO: 6503 - DNA, 19 bp, Artificial Sequence
  Description of Artificial Sequence: Chemically synthesized oligonucleotide
gaggacagcccaggcattc

SEQ ID NO: 6504 - DNA, 19 bp, Artificial Sequence
  Description of Artificial Sequence: Chemically synthesized oligonucleotide
gaatgcctgggctgtcctc

SEQ ID NO: 6505 - DNA, 19 bp, Artificial Sequence
  Description of Artificial Sequence: Chemically synthesized oligonucleotide
aggacagcccaggcattcc

SEQ ID NO: 6506 - DNA, 19 bp, Artificial Sequence
  Description of Artificial Sequence: Chemically synthesized oligonucleotide
ggaatgcctgggctgtcct

SEQ ID NO: 6507 - DNA, 19 bp, Artificial Sequence
  Description of Artificial Sequence: Chemically synthesized oligonucleotide
ggacagcccaggcattcca

SEQ ID NO: 6508 - DNA, 19 bp, Artificial Sequence
  Description of Artificial Sequence: Chemically synthesized oligonucleotide
tggaatgcctgggctgtcc

SEQ ID NO: 6509 - DNA, 19 bp, Artificial Sequence
  Description of Artificial Sequence: Chemically synthesized oligonucleotide
gacagcccaggcattccac

SEQ ID NO: 6510 - DNA, 19 bp, Artificial Sequence
  Description of Artificial Sequence: Chemically synthesized oligonucleotide
gtggaatgcctgggctgtc

SEQ ID NO: 6511 - DNA, 19 bp, Artificial Sequence
  Description of Artificial Sequence: Chemically synthesized oligonucleotide
acagcccaggcattccacg

SEQ ID NO: 6512 - DNA, 19 bp, Artificial Sequence
  Description of Artificial Sequence: Chemically synthesized oligonucleotide
cgtggaatgcctgggctgt

SEQ ID NO: 6513 - DNA, 19 bp, Artificial Sequence
  Description of Artificial Sequence: Chemically synthesized oligonucleotide
cagcccaggcattccacgc

SEQ ID NO: 6514 - DNA, 19 bp, Artificial Sequence
  Description of Artificial Sequence: Chemically synthesized oligonucleotide
gcgtggaatgcctgggctg

SEQ ID NO: 6515 - DNA, 19 bp, Artificial Sequence
  Description of Artificial Sequence: Chemically synthesized oligonucleotide
agcccaggcattccacgct

SEQ ID NO: 6516 - DNA, 19 bp, Artificial Sequence
  Description of Artificial Sequence: Chemically synthesized oligonucleotide
agcgtggaatgcctgggct

SEQ ID NO: 6517 - DNA, 19 bp, Artificial Sequence
  Description of Artificial Sequence: Chemically synthesized oligonucleotide
gcccaggcattccacgctg

SEQ ID NO: 6518 - DNA, 19 bp, Artificial Sequence
  Description of Artificial Sequence: Chemically synthesized oligonucleotide
cagcgtggaatgcctgggc

SEQ ID NO: 6519 - DNA, 19 bp, Artificial Sequence
  Description of Artificial Sequence: Chemically synthesized oligonucleotide
cccaggcattccacgctgc

SEQ ID NO: 6520 - DNA, 19 bp, Artificial Sequence
  Description of Artificial Sequence: Chemically synthesized oligonucleotide
gcagcgtggaatgcctggg

SEQ ID NO: 6521 - DNA, 19 bp, Artificial Sequence
  Description of Artificial Sequence: Chemically synthesized oligonucleotide
ccaggcattccacgctgct

SEQ ID NO: 6522 - DNA, 19 bp, Artificial Sequence
  Description of Artificial Sequence: Chemically synthesized oligonucleotide
agcagcgtggaatgcctgg

SEQ ID NO: 6523 - DNA, 19 bp, Artificial Sequence
  Description of Artificial Sequence: Chemically synthesized oligonucleotide
caggcattccacgctgctg

SEQ ID NO: 6524 - DNA, 19 bp, Artificial Sequence
  Description of Artificial Sequence: Chemically synthesized oligonucleotide
cagcagcgtggaatgcctg

SEQ ID NO: 6525 - DNA, 19 bp, Artificial Sequence
  Description of Artificial Sequence: Chemically synthesized oligonucleotide
aggcattccacgctgctgc

SEQ ID NO: 6526 - DNA, 19 bp, Artificial Sequence
  Description of Artificial Sequence: Chemically synthesized oligonucleotide
gcagcagcgtggaatgcct

SEQ ID NO: 6527 - DNA, 19 bp, Artificial Sequence
  Description of Artificial Sequence: Chemically synthesized oligonucleotide
ggcattccacgctgctgca

SEQ ID NO: 6528 - DNA, 19 bp, Artificial Sequence
  Description of Artificial Sequence: Chemically synthesized oligonucleotide
tgcagcagcgtggaatgcc

SEQ ID NO: 6529 - DNA, 19 bp, Artificial Sequence
  Description of Artificial Sequence: Chemically synthesized oligonucleotide
gcattccacgctgctgcag

SEQ ID NO: 6530 - DNA, 19 bp, Artificial Sequence
  Description of Artificial Sequence: Chemically synthesized oligonucleotide
ctgcagcagcgtggaatgc

SEQ ID NO: 6531 - DNA, 19 bp, Artificial Sequence
  Description of Artificial Sequence: Chemically synthesized oligonucleotide
cattccacgctgctgcagc

SEQ ID NO: 6532 - DNA, 19 bp, Artificial Sequence
  Description of Artificial Sequence: Chemically synthesized oligonucleotide
gctgcagcagcgtggaatg

SEQ ID NO: 6533 - DNA, 19 bp, Artificial Sequence
  Description of Artificial Sequence: Chemically synthesized oligonucleotide
attccacgctgctgcagcc

SEQ ID NO: 6534 - DNA, 19 bp, Artificial Sequence
  Description of Artificial Sequence: Chemically synthesized oligonucleotide
ggctgcagcagcgtggaat

SEQ ID NO: 6535 - DNA, 19 bp, Artificial Sequence
  Description of Artificial Sequence: Chemically synthesized oligonucleotide
ttccacgctgctgcagccg

SEQ ID NO: 6536 - DNA, 19 bp, Artificial Sequence
  Description of Artificial Sequence: Chemically synthesized oligonucleotide
cggctgcagcagcgtggaa

SEQ ID NO: 6537 - DNA, 19 bp, Artificial Sequence
  Description of Artificial Sequence: Chemically synthesized oligonucleotide
tccacgctgctgcagccgt

SEQ ID NO: 6538 - DNA, 19 bp, Artificial Sequence
  Description of Artificial Sequence: Chemically synthesized oligonucleotide
acggctgcagcagcgtgga

SEQ ID NO: 6539 - DNA, 19 bp, Artificial Sequence
  Description of Artificial Sequence: Chemically synthesized oligonucleotide
ccacgctgctgcagccgtt

SEQ ID NO: 6540 - DNA, 19 bp, Artificial Sequence
  Description of Artificial Sequence: Chemically synthesized oligonucleotide
aacggctgcagcagcgtgg

SEQ ID NO: 6541 - DNA, 19 bp, Artificial Sequence
  Description of Artificial Sequence: Chemically synthesized oligonucleotide
cacgctgctgcagccgttg

SEQ ID NO: 6542 - DNA, 19 bp, Artificial Sequence
  Description of Artificial Sequence: Chemically synthesized oligonucleotide
caacggctgcagcagcgtg

SEQ ID NO: 6543 - DNA, 19 bp, Artificial Sequence
  Description of Artificial Sequence: Chemically synthesized oligonucleotide
acgctgctgcagccgttgc

SEQ ID NO: 6544 - DNA, 19 bp, Artificial Sequence
  Description of Artificial Sequence: Chemically synthesized oligonucleotide
gcaacggctgcagcagcgt

SEQ ID NO: 6545 - DNA, 19 bp, Artificial Sequence
  Description of Artificial Sequence: Chemically synthesized oligonucleotide
cgctgctgcagccgttgcc

SEQ ID NO: 6546 - DNA, 19 bp, Artificial Sequence
  Description of Artificial Sequence: Chemically synthesized oligonucleotide
ggcaacggctgcagcagcg

SEQ ID NO: 6547 - DNA, 19 bp, Artificial Sequence
  Description of Artificial Sequence: Chemically synthesized oligonucleotide
gctgctgcagccgttgcca

SEQ ID NO: 6548 - DNA, 19 bp, Artificial Sequence
  Description of Artificial Sequence: Chemically synthesized oligonucleotide
tggcaacggctgcagcagc

SEQ ID NO: 6549 - DNA, 19 bp, Artificial Sequence
  Description of Artificial Sequence: Chemically synthesized oligonucleotide
ctgctgcagccgttgccac

SEQ ID NO: 6550 - DNA, 19 bp, Artificial Sequence
  Description of Artificial Sequence: Chemically synthesized oligonucleotide
gtggcaacggctgcagcag

SEQ ID NO: 6551 - DNA, 19 bp, Artificial Sequence
  Description of Artificial Sequence: Chemically synthesized oligonucleotide
tgctgcagccgttgccacc

SEQ ID NO: 6552 - DNA, 19 bp, Artificial Sequence
  Description of Artificial Sequence: Chemically synthesized oligonucleotide
ggtggcaacggctgcagca

SEQ ID NO: 6553 - DNA, 19 bp, Artificial Sequence
  Description of Artificial Sequence: Chemically synthesized oligonucleotide
gctgcagccgttgccacca

SEQ ID NO: 6554 - DNA, 19 bp, Artificial Sequence
  Description of Artificial Sequence: Chemically synthesized oligonucleotide
tggtggcaacggctgcagc

SEQ ID NO: 6555 - DNA, 19 bp, Artificial Sequence
  Description of Artificial Sequence: Chemically synthesized oligonucleotide
ctgcagccgttgccaccat

SEQ ID NO: 6556 - DNA, 19 bp, Artificial Sequence
  Description of Artificial Sequence: Chemically synthesized oligonucleotide
atggtggcaacggctgcag

SEQ ID NO: 6557 - DNA, 19 bp, Artificial Sequence
  Description of Artificial Sequence: Chemically synthesized oligonucleotide
tgcagccgttgccaccatg

SEQ ID NO: 6558 - DNA, 19 bp, Artificial Sequence
  Description of Artificial Sequence: Chemically synthesized oligonucleotide
catggtggcaacggctgca

SEQ ID NO: 6559 - DNA, 19 bp, Artificial Sequence
  Description of Artificial Sequence: Chemically synthesized oligonucleotide
gcagccgttgccaccatgg

SEQ ID NO: 6560 - DNA, 19 bp, Artificial Sequence
  Description of Artificial Sequence: Chemically synthesized oligonucleotide
ccatggtggcaacggctgc

SEQ ID NO: 6561 - DNA, 19 bp, Artificial Sequence
  Description of Artificial Sequence: Chemically synthesized oligonucleotide
cagccgttgccaccatgga

SEQ ID NO: 6562 - DNA, 19 bp, Artificial Sequence
  Description of Artificial Sequence: Chemically synthesized oligonucleotide
tccatggtggcaacggctg

SEQ ID NO: 6563 - DNA, 19 bp, Artificial Sequence
  Description of Artificial Sequence: Chemically synthesized oligonucleotide
agccgttgccaccatggac

SEQ ID NO: 6564 - DNA, 19 bp, Artificial Sequence
  Description of Artificial Sequence: Chemically synthesized oligonucleotide
gtccatggtggcaacggct

SEQ ID NO: 6565 - DNA, 19 bp, Artificial Sequence
  Description of Artificial Sequence: Chemically synthesized oligonucleotide
gccgttgccaccatggact

SEQ ID NO: 6566 - DNA, 19 bp, Artificial Sequence
  Description of Artificial Sequence: Chemically synthesized oligonucleotide
agtccatggtggcaacggc

SEQ ID NO: 6567 - DNA, 19 bp, Artificial Sequence
  Description of Artificial Sequence: Chemically synthesized oligonucleotide
ccgttgccaccatggactc

SEQ ID NO: 6568 - DNA, 19 bp, Artificial Sequence
  Description of Artificial Sequence: Chemically synthesized oligonucleotide
gagtccatggtggcaacgg

SEQ ID NO: 6569 - DNA, 19 bp, Artificial Sequence
  Description of Artificial Sequence: Chemically synthesized oligonucleotide
cgttgccaccatggactct

SEQ ID NO: 6570 - DNA, 19 bp, Artificial Sequence
  Description of Artificial Sequence: Chemically synthesized oligonucleotide
agagtccatggtggcaacg

SEQ ID NO: 6571 - DNA, 19 bp, Artificial Sequence
  Description of Artificial Sequence: Chemically synthesized oligonucleotide
gttgccaccatggactctt

SEQ ID NO: 6572 - DNA, 19 bp, Artificial Sequence
  Description of Artificial Sequence: Chemically synthesized oligonucleotide
aagagtccatggtggcaac

SEQ ID NO: 6573 - DNA, 19 bp, Artificial Sequence
  Description of Artificial Sequence: Chemically synthesized oligonucleotide
ttgccaccatggactcttc

SEQ ID NO: 6574 - DNA, 19 bp, Artificial Sequence
  Description of Artificial Sequence: Chemically synthesized oligonucleotide
gaagagtccatggtggcaa

SEQ ID NO: 6575 - DNA, 19 bp, Artificial Sequence
  Description of Artificial Sequence: Chemically synthesized oligonucleotide
tgccaccatggactcttca

SEQ ID NO: 6576 - DNA, 19 bp, Artificial Sequence
  Description of Artificial Sequence: Chemically synthesized oligonucleotide
tgaagagtccatggtggca

SEQ ID NO: 6577 - DNA, 19 bp, Artificial Sequence
  Description of Artificial Sequence: Chemically synthesized oligonucleotide
gccaccatggactcttcaa

SEQ ID NO: 6578 - DNA, 19 bp, Artificial Sequence
  Description of Artificial Sequence: Chemically synthesized oligonucleotide
ttgaagagtccatggtggc

SEQ ID NO: 6579 - DNA, 19 bp, Artificial Sequence
  Description of Artificial Sequence: Chemically synthesized oligonucleotide
ccaccatggactcttcaac

SEQ ID NO: 6580 - DNA, 19 bp, Artificial Sequence
  Description of Artificial Sequence: Chemically synthesized oligonucleotide
gttgaagagtccatggtgg

SEQ ID NO: 6581 - DNA, 19 bp, Artificial Sequence
  Description of Artificial Sequence: Chemically synthesized oligonucleotide
caccatggactcttcaaca

SEQ ID NO: 6582 - DNA, 19 bp, Artificial Sequence
  Description of Artificial Sequence: Chemically synthesized oligonucleotide
tgttgaagagtccatggtg

SEQ ID NO: 6583 - DNA, 19 bp, Artificial Sequence
  Description of Artificial Sequence: Chemically synthesized oligonucleotide
accatggactcttcaacac

SEQ ID NO: 6584 - DNA, 19 bp, Artificial Sequence
  Description of Artificial Sequence: Chemically synthesized oligonucleotide
gtgttgaagagtccatggt

SEQ ID NO: 6585 - DNA, 19 bp, Artificial Sequence
  Description of Artificial Sequence: Chemically synthesized oligonucleotide
ccatggactcttcaacacc

SEQ ID NO: 6586 - DNA, 19 bp, Artificial Sequence
  Description of Artificial Sequence: Chemically synthesized oligonucleotide
ggtgttgaagagtccatgg

SEQ ID NO: 6587 - DNA, 19 bp, Artificial Sequence
  Description of Artificial Sequence: Chemically synthesized oligonucleotide
catggactcttcaacaccc

SEQ ID NO: 6588 - DNA, 19 bp, Artificial Sequence
  Description of Artificial Sequence: Chemically synthesized oligonucleotide
gggtgttgaagagtccatg

SEQ ID NO: 6589 - DNA, 19 bp, Artificial Sequence
  Description of Artificial Sequence: Chemically synthesized oligonucleotide
atggactcttcaacaccca

SEQ ID NO: 6590 - DNA, 19 bp, Artificial Sequence
  Description of Artificial Sequence: Chemically synthesized oligonucleotide
tgggtgttgaagagtccat

SEQ ID NO: 6591 - DNA, 19 bp, Artificial Sequence
  Description of Artificial Sequence: Chemically synthesized oligonucleotide
tggactcttcaacacccac

SEQ ID NO: 6592 - DNA, 19 bp, Artificial Sequence
  Description of Artificial Sequence: Chemically synthesized oligonucleotide
gtgggtgttgaagagtcca

SEQ ID NO: 6593 - DNA, 19 bp, Artificial Sequence
  Description of Artificial Sequence: Chemically synthesized oligonucleotide
ggactcttcaacacccact

SEQ ID NO: 6594 - DNA, 19 bp, Artificial Sequence
  Description of Artificial Sequence: Chemically synthesized oligonucleotide
agtgggtgttgaagagtcc

SEQ ID NO: 6595 - DNA, 19 bp, Artificial Sequence
  Description of Artificial Sequence: Chemically synthesized oligonucleotide
gactcttcaacacccactg

SEQ ID NO: 6596 - DNA, 19 bp, Artificial Sequence
  Description of Artificial Sequence: Chemically synthesized oligonucleotide
cagtgggtgttgaagagtc

SEQ ID NO: 6597 - DNA, 19 bp, Artificial Sequence
  Description of Artificial Sequence: Chemically synthesized oligonucleotide
actcttcaacacccactgg

SEQ ID NO: 6598 - DNA, 19 bp, Artificial Sequence
  Description of Artificial Sequence: Chemically synthesized oligonucleotide
ccagtgggtgttgaagagt

SEQ ID NO: 6599 - DNA, 19 bp, Artificial Sequence
  Description of Artificial Sequence: Chemically synthesized oligonucleotide
ctcttcaacacccactggc

SEQ ID NO: 6600 - DNA, 19 bp, Artificial Sequence
  Description of Artificial Sequence: Chemically synthesized oligonucleotide
gccagtgggtgttgaagag

SEQ ID NO: 6601 - DNA, 19 bp, Artificial Sequence
  Description of Artificial Sequence: Chemically synthesized oligonucleotide
tcttcaacacccactggcg

SEQ ID NO: 6602 - DNA, 19 bp, Artificial Sequence
  Description of Artificial Sequence: Chemically synthesized oligonucleotide
cgccagtgggtgttgaaga

SEQ ID NO: 6603 - DNA, 19 bp, Artificial Sequence
  Description of Artificial Sequence: Chemically synthesized oligonucleotide
cttcaacacccactggcga

SEQ ID NO: 6604 - DNA, 19 bp, Artificial Sequence
  Description of Artificial Sequence: Chemically synthesized oligonucleotide
tcgccagtgggtgttgaag

SEQ ID NO: 6605 - DNA, 19 bp, Artificial Sequence
  Description of Artificial Sequence: Chemically synthesized oligonucleotide
ttcaacacccactggcgat

SEQ ID NO: 6606 - DNA, 19 bp, Artificial Sequence
  Description of Artificial Sequence: Chemically synthesized oligonucleotide
atcgccagtgggtgttgaa

SEQ ID NO: 6607 - DNA, 19 bp, Artificial Sequence
  Description of Artificial Sequence: Chemically synthesized oligonucleotide
tcaacacccactggcgatg

SEQ ID NO: 6608 - DNA, 19 bp, Artificial Sequence
  Description of Artificial Sequence: Chemically synthesized oligonucleotide
catcgccagtgggtgttga

SEQ ID NO: 6609 - DNA, 19 bp, Artificial Sequence
  Description of Artificial Sequence: Chemically synthesized oligonucleotide
caacacccactggcgatgt

SEQ ID NO: 6610 - DNA, 19 bp, Artificial Sequence
  Description of Artificial Sequence: Chemically synthesized oligonucleotide
acatcgccagtgggtgttg

SEQ ID NO: 6611 - DNA, 19 bp, Artificial Sequence
  Description of Artificial Sequence: Chemically synthesized oligonucleotide
aacacccactggcgatgtc

SEQ ID NO: 6612 - DNA, 19 bp, Artificial Sequence
  Description of Artificial Sequence: Chemically synthesized oligonucleotide
gacatcgccagtgggtgtt

SEQ ID NO: 6613 - DNA, 19 bp, Artificial Sequence
  Description of Artificial Sequence: Chemically synthesized oligonucleotide
acacccactggcgatgtcc

SEQ ID NO: 6614 - DNA, 19 bp, Artificial Sequence
  Description of Artificial Sequence: Chemically synthesized oligonucleotide
ggacatcgccagtgggtgt

SEQ ID NO: 6615 - DNA, 19 bp, Artificial Sequence
  Description of Artificial Sequence: Chemically synthesized oligonucleotide
cacccactggcgatgtccc

SEQ ID NO: 6616 - DNA, 19 bp, Artificial Sequence
  Description of Artificial Sequence: Chemically synthesized oligonucleotide
gggacatcgccagtgggtg

SEQ ID NO: 6617 - DNA, 19 bp, Artificial Sequence
  Description of Artificial Sequence: Chemically synthesized oligonucleotide
acccactggcgatgtcccc

SEQ ID NO: 6618 - DNA, 19 bp, Artificial Sequence
  Description of Artificial Sequence: Chemically synthesized oligonucleotide
ggggacatcgccagtgggt

SEQ ID NO: 6619 - DNA, 19 bp, Artificial Sequence
  Description of Artificial Sequence: Chemically synthesized oligonucleotide
cccactggcgatgtccccg

SEQ ID NO: 6620 - DNA, 19 bp, Artificial Sequence
  Description of Artificial Sequence: Chemically synthesized oligonucleotide
cggggacatcgccagtggg

SEQ ID NO: 6621 - DNA, 19 bp, Artificial Sequence
  Description of Artificial Sequence: Chemically synthesized oligonucleotide
ccactggcgatgtccccgc

SEQ ID NO: 6622 - DNA, 19 bp, Artificial Sequence
  Description of Artificial Sequence: Chemically synthesized oligonucleotide
gcggggacatcgccagtgg

SEQ ID NO: 6623 - DNA, 19 bp, Artificial Sequence
  Description of Artificial Sequence: Chemically synthesized oligonucleotide
cactggcgatgtccccgct

SEQ ID NO: 6624 - DNA, 19 bp, Artificial Sequence
  Description of Artificial Sequence: Chemically synthesized oligonucleotide
agcggggacatcgccagtg

SEQ ID NO: 6625 - DNA, 19 bp, Artificial Sequence
  Description of Artificial Sequence: Chemically synthesized oligonucleotide
actggcgatgtccccgctg

SEQ ID NO: 6626 - DNA, 19 bp, Artificial Sequence
  Description of Artificial Sequence: Chemically synthesized oligonucleotide
cagcggggacatcgccagt

SEQ ID NO: 6627 - DNA, 19 bp, Artificial Sequence
  Description of Artificial Sequence: Chemically synthesized oligonucleotide
ctggcgatgtccccgctgc

SEQ ID NO: 6628 - DNA, 19 bp, Artificial Sequence
  Description of Artificial Sequence: Chemically synthesized oligonucleotide
gcagcggggacatcgccag

SEQ ID NO: 6629 - DNA, 19 bp, Artificial Sequence
  Description of Artificial Sequence: Chemically synthesized oligonucleotide
tggcgatgtccccgctgca

SEQ ID NO: 6630 - DNA, 19 bp, Artificial Sequence
  Description of Artificial Sequence: Chemically synthesized oligonucleotide
tgcagcggggacatcgcca

SEQ ID NO: 6631 - DNA, 19 bp, Artificial Sequence
  Description of Artificial Sequence: Chemically synthesized oligonucleotide
ggcgatgtccccgctgcag

SEQ ID NO: 6632 - DNA, 19 bp, Artificial Sequence
  Description of Artificial Sequence: Chemically synthesized oligonucleotide
ctgcagcggggacatcgcc

SEQ ID NO: 6633 - DNA, 19 bp, Artificial Sequence
  Description of Artificial Sequence: Chemically synthesized oligonucleotide
gcgatgtccccgctgcagc

SEQ ID NO: 6634 - DNA, 19 bp, Artificial Sequence
  Description of Artificial Sequence: Chemically synthesized oligonucleotide
gctgcagcggggacatcgc

SEQ ID NO: 6635 - DNA, 19 bp, Artificial Sequence
  Description of Artificial Sequence: Chemically synthesized oligonucleotide
cgatgtccccgctgcagcc

SEQ ID NO: 6636 - DNA, 19 bp, Artificial Sequence
  Description of Artificial Sequence: Chemically synthesized oligonucleotide
ggctgcagcggggacatcg

SEQ ID NO: 6637 - DNA, 19 bp, Artificial Sequence
  Description of Artificial Sequence: Chemically synthesized oligonucleotide
gatgtccccgctgcagcca

SEQ ID NO: 6638 - DNA, 19 bp, Artificial Sequence
  Description of Artificial Sequence: Chemically synthesized oligonucleotide
tggctgcagcggggacatc

SEQ ID NO: 6639 - DNA, 19 bp, Artificial Sequence
  Description of Artificial Sequence: Chemically synthesized oligonucleotide
atgtccccgctgcagccac

SEQ ID NO: 6640 - DNA, 19 bp, Artificial Sequence
  Description of Artificial Sequence: Chemically synthesized oligonucleotide
gtggctgcagcggggacat

SEQ ID NO: 6641 - DNA, 19 bp, Artificial Sequence
  Description of Artificial Sequence: Chemically synthesized oligonucleotide
tgtccccgctgcagccacc

SEQ ID NO: 6642 - DNA, 19 bp, Artificial Sequence
  Description of Artificial Sequence: Chemically synthesized oligonucleotide
ggtggctgcagcggggaca

SEQ ID NO: 6643 - DNA, 19 bp, Artificial Sequence
  Description of Artificial Sequence: Chemically synthesized oligonucleotide
gtccccgctgcagccaccg

SEQ ID NO: 6644 - DNA, 19 bp, Artificial Sequence
  Description of Artificial Sequence: Chemically synthesized oligonucleotide
cggtggctgcagcggggac

SEQ ID NO: 6645 - DNA, 19 bp, Artificial Sequence
  Description of Artificial Sequence: Chemically synthesized oligonucleotide
tccccgctgcagccaccgg

SEQ ID NO: 6646 - DNA, 19 bp, Artificial Sequence
  Description of Artificial Sequence: Chemically synthesized oligonucleotide
ccggtggctgcagcgggga

SEQ ID NO: 6647 - DNA, 19 bp, Artificial Sequence
  Description of Artificial Sequence: Chemically synthesized oligonucleotide
ccccgctgcagccaccggc

SEQ ID NO: 6648 - DNA, 19 bp, Artificial Sequence
  Description of Artificial Sequence: Chemically synthesized oligonucleotide
gccggtggctgcagcgggg

SEQ ID NO: 6649 - DNA, 19 bp, Artificial Sequence
  Description of Artificial Sequence: Chemically synthesized oligonucleotide
cccgctgcagccaccggct

SEQ ID NO: 6650 - DNA, 19 bp, Artificial Sequence
  Description of Artificial Sequence: Chemically synthesized oligonucleotide
agccggtggctgcagcggg

SEQ ID NO: 6651 - DNA, 19 bp, Artificial Sequence
  Description of Artificial Sequence: Chemically synthesized oligonucleotide
ccgctgcagccaccggctg

SEQ ID NO: 6652 - DNA, 19 bp, Artificial Sequence
  Description of Artificial Sequence: Chemically synthesized oligonucleotide
cagccggtggctgcagcgg

SEQ ID NO: 6653 - DNA, 19 bp, Artificial Sequence
  Description of Artificial Sequence: Chemically synthesized oligonucleotide
cgctgcagccaccggctgt

SEQ ID NO: 6654 - DNA, 19 bp, Artificial Sequence
  Description of Artificial Sequence: Chemically synthesized oligonucleotide
acagccggtggctgcagcg

SEQ ID NO: 6655 - DNA, 19 bp, Artificial Sequence
  Description of Artificial Sequence: Chemically synthesized oligonucleotide
gctgcagccaccggctgtg

SEQ ID NO: 6656 - DNA, 19 bp, Artificial Sequence
  Description of Artificial Sequence: Chemically synthesized oligonucleotide
cacagccggtggctgcagc

SEQ ID NO: 6657 - DNA, 19 bp, Artificial Sequence
  Description of Artificial Sequence: Chemically synthesized oligonucleotide
ctgcagccaccggctgtgt

SEQ ID NO: 6658 - DNA, 19 bp, Artificial Sequence
  Description of Artificial Sequence: Chemically synthesized oligonucleotide
acacagccggtggctgcag

SEQ ID NO: 6659 - DNA, 19 bp, Artificial Sequence
  Description of Artificial Sequence: Chemically synthesized oligonucleotide
tgcagccaccggctgtgtg

SEQ ID NO: 6660 - DNA, 19 bp, Artificial Sequence
  Description of Artificial Sequence: Chemically synthesized oligonucleotide
cacacagccggtggctgca

SEQ ID NO: 6661 - DNA, 19 bp, Artificial Sequence
  Description of Artificial Sequence: Chemically synthesized oligonucleotide
gcagccaccggctgtgtgt

SEQ ID NO: 6662 - DNA, 19 bp, Artificial Sequence
  Description of Artificial Sequence: Chemically synthesized oligonucleotide
acacacagccggtggctgc

SEQ ID NO: 6663 - DNA, 19 bp, Artificial Sequence
  Description of Artificial Sequence: Chemically synthesized oligonucleotide
cagccaccggctgtgtgtg

SEQ ID NO: 6664 - DNA, 19 bp, Artificial Sequence
  Description of Artificial Sequence: Chemically synthesized oligonucleotide
cacacacagccggtggctg

SEQ ID NO: 6665 - DNA, 19 bp, Artificial Sequence
  Description of Artificial Sequence: Chemically synthesized oligonucleotide
agccaccggctgtgtgtgg

SEQ ID NO: 6666 - DNA, 19 bp, Artificial Sequence
  Description of Artificial Sequence: Chemically synthesized oligonucleotide
ccacacacagccggtggct

SEQ ID NO: 6667 - DNA, 19 bp, Artificial Sequence
  Description of Artificial Sequence: Chemically synthesized oligonucleotide
gccaccggctgtgtgtggc

SEQ ID NO: 6668 - DNA, 19 bp, Artificial Sequence
  Description of Artificial Sequence: Chemically synthesized oligonucleotide
gccacacacagccggtggc

SEQ ID NO: 6669 - DNA, 19 bp, Artificial Sequence
  Description of Artificial Sequence: Chemically synthesized oligonucleotide
ccaccggctgtgtgtggcc

SEQ ID NO: 6670 - DNA, 19 bp, Artificial Sequence
  Description of Artificial Sequence: Chemically synthesized oligonucleotide
ggccacacacagccggtgg

SEQ ID NO: 6671 - DNA, 19 bp, Artificial Sequence
  Description of Artificial Sequence: Chemically synthesized oligonucleotide
caccggctgtgtgtggcct

SEQ ID NO: 6672 - DNA, 19 bp, Artificial Sequence
  Description of Artificial Sequence: Chemically synthesized oligonucleotide
aggccacacacagccggtg

SEQ ID NO: 6673 - DNA, 19 bp, Artificial Sequence
  Description of Artificial Sequence: Chemically synthesized oligonucleotide
accggctgtgtgtggcctg

SEQ ID NO: 6674 - DNA, 19 bp, Artificial Sequence
  Description of Artificial Sequence: Chemically synthesized oligonucleotide
caggccacacacagccggt

SEQ ID NO: 6675 - DNA, 19 bp, Artificial Sequence
  Description of Artificial Sequence: Chemically synthesized oligonucleotide
ccggctgtgtgtggcctgt

SEQ ID NO: 6676 - DNA, 19 bp, Artificial Sequence
  Description of Artificial Sequence: Chemically synthesized oligonucleotide
acaggccacacacagccgg

SEQ ID NO: 6677 - DNA, 19 bp, Artificial Sequence
  Description of Artificial Sequence: Chemically synthesized oligonucleotide
cggctgtgtgtggcctgtg

SEQ ID NO: 6678 - DNA, 19 bp, Artificial Sequence
  Description of Artificial Sequence: Chemically synthesized oligonucleotide
cacaggccacacacagccg

SEQ ID NO: 6679 - DNA, 19 bp, Artificial Sequence
  Description of Artificial Sequence: Chemically synthesized oligonucleotide
ggctgtgtgtggcctgtgg

SEQ ID NO: 6680 - DNA, 19 bp, Artificial Sequence
  Description of Artificial Sequence: Chemically synthesized oligonucleotide
ccacaggccacacacagcc

SEQ ID NO: 6681 - DNA, 19 bp, Artificial Sequence
  Description of Artificial Sequence: Chemically synthesized oligonucleotide
gctgtgtgtggcctgtggt

SEQ ID NO: 6682 - DNA, 19 bp, Artificial Sequence
  Description of Artificial Sequence: Chemically synthesized oligonucleotide
accacaggccacacacagc

SEQ ID NO: 6683 - DNA, 19 bp, Artificial Sequence
  Description of Artificial Sequence: Chemically synthesized oligonucleotide
ctgtgtgtggcctgtggtc

SEQ ID NO: 6684 - DNA, 19 bp, Artificial Sequence
  Description of Artificial Sequence: Chemically synthesized oligonucleotide
gaccacaggccacacacag

SEQ ID NO: 6685 - DNA, 19 bp, Artificial Sequence
  Description of Artificial Sequence: Chemically synthesized oligonucleotide
tgtgtgtggcctgtggtcg

SEQ ID NO: 6686 - DNA, 19 bp, Artificial Sequence
  Description of Artificial Sequence: Chemically synthesized oligonucleotide
cgaccacaggccacacaca

SEQ ID NO: 6687 - DNA, 19 bp, Artificial Sequence
  Description of Artificial Sequence: Chemically synthesized oligonucleotide
gtgtgtggcctgtggtcgt

SEQ ID NO: 6688 - DNA, 19 bp, Artificial Sequence
  Description of Artificial Sequence: Chemically synthesized oligonucleotide
acgaccacaggccacacac

SEQ ID NO: 6689 - DNA, 19 bp, Artificial Sequence
  Description of Artificial Sequence: Chemically synthesized oligonucleotide
tgtgtggcctgtggtcgtg

SEQ ID NO: 6690 - DNA, 19 bp, Artificial Sequence
  Description of Artificial Sequence: Chemically synthesized oligonucleotide
cacgaccacaggccacaca

SEQ ID NO: 6691 - DNA, 19 bp, Artificial Sequence
  Description of Artificial Sequence: Chemically synthesized oligonucleotide
gtgtggcctgtggtcgtgt

SEQ ID NO: 6692 - DNA, 19 bp, Artificial Sequence
  Description of Artificial Sequence: Chemically synthesized oligonucleotide
acacgaccacaggccacac

SEQ ID NO: 6693 - DNA, 19 bp, Artificial Sequence
  Description of Artificial Sequence: Chemically synthesized oligonucleotide
tgtggcctgtggtcgtgtg

SEQ ID NO: 6694 - DNA, 19 bp, Artificial Sequence
  Description of Artificial Sequence: Chemically synthesized oligonucleotide
cacacgaccacaggccaca

SEQ ID NO: 6695 - DNA, 19 bp, Artificial Sequence
  Description of Artificial Sequence: Chemically synthesized oligonucleotide
gtggcctgtggtcgtgtgg

SEQ ID NO: 6696 - DNA, 19 bp, Artificial Sequence
  Description of Artificial Sequence: Chemically synthesized oligonucleotide
ccacacgaccacaggccac

SEQ ID NO: 6697 - DNA, 19 bp, Artificial Sequence
  Description of Artificial Sequence: Chemically synthesized oligonucleotide
tggcctgtggtcgtgtggc

SEQ ID NO: 6698 - DNA, 19 bp, Artificial Sequence
  Description of Artificial Sequence: Chemically synthesized oligonucleotide
gccacacgaccacaggcca

SEQ ID NO: 6699 - DNA, 19 bp, Artificial Sequence
  Description of Artificial Sequence: Chemically synthesized oligonucleotide
ggcctgtggtcgtgtggca

SEQ ID NO: 6700 - DNA, 19 bp, Artificial Sequence
  Description of Artificial Sequence: Chemically synthesized oligonucleotide
tgccacacgaccacaggcc

SEQ ID NO: 6701 - DNA, 19 bp, Artificial Sequence
  Description of Artificial Sequence: Chemically synthesized oligonucleotide
gcctgtggtcgtgtggcag

SEQ ID NO: 6702 - DNA, 19 bp, Artificial Sequence
  Description of Artificial Sequence: Chemically synthesized oligonucleotide
ctgccacacgaccacaggc

SEQ ID NO: 6703 - DNA, 19 bp, Artificial Sequence
  Description of Artificial Sequence: Chemically synthesized oligonucleotide
cctgtggtcgtgtggcagg

SEQ ID NO: 6704 - DNA, 19 bp, Artificial Sequence
  Description of Artificial Sequence: Chemically synthesized oligonucleotide
cctgccacacgaccacagg

SEQ ID NO: 6705 - DNA, 19 bp, Artificial Sequence
  Description of Artificial Sequence: Chemically synthesized oligonucleotide
ctgtggtcgtgtggcaggc

SEQ ID NO: 6706 - DNA, 19 bp, Artificial Sequence
  Description of Artificial Sequence: Chemically synthesized oligonucleotide
gcctgccacacgaccacag

SEQ ID NO: 6707 - DNA, 19 bp, Artificial Sequence
  Description of Artificial Sequence: Chemically synthesized oligonucleotide
tgtggtcgtgtggcaggca

SEQ ID NO: 6708 - DNA, 19 bp, Artificial Sequence
  Description of Artificial Sequence: Chemically synthesized oligonucleotide
tgcctgccacacgaccaca

SEQ ID NO: 6709 - DNA, 19 bp, Artificial Sequence
  Description of Artificial Sequence: Chemically synthesized oligonucleotide
gtggtcgtgtggcaggcac

SEQ ID NO: 6710 - DNA, 19 bp, Artificial Sequence
  Description of Artificial Sequence: Chemically synthesized oligonucleotide
gtgcctgccacacgaccac

SEQ ID NO: 6711 - DNA, 19 bp, Artificial Sequence
  Description of Artificial Sequence: Chemically synthesized oligonucleotide
tggtcgtgtggcaggcact

SEQ ID NO: 6712 - DNA, 19 bp, Artificial Sequence
  Description of Artificial Sequence: Chemically synthesized oligonucleotide
agtgcctgccacacgacca

SEQ ID NO: 6713 - DNA, 19 bp, Artificial Sequence
  Description of Artificial Sequence: Chemically synthesized oligonucleotide
ggtcgtgtggcaggcactg

SEQ ID NO: 6714 - DNA, 19 bp, Artificial Sequence
  Description of Artificial Sequence: Chemically synthesized oligonucleotide
cagtgcctgccacacgacc

SEQ ID NO: 6715 - DNA, 19 bp, Artificial Sequence
  Description of Artificial Sequence: Chemically synthesized oligonucleotide
gtcgtgtggcaggcactgg

SEQ ID NO: 6716 - DNA, 19 bp, Artificial Sequence
  Description of Artificial Sequence: Chemically synthesized oligonucleotide
ccagtgcctgccacacgac

SEQ ID NO: 6717 - DNA, 19 bp, Artificial Sequence
  Description of Artificial Sequence: Chemically synthesized oligonucleotide
tcgtgtggcaggcactggg

SEQ ID NO: 6718 - DNA, 19 bp, Artificial Sequence
  Description of Artificial Sequence: Chemically synthesized oligonucleotide
cccagtgcctgccacacga

SEQ ID NO: 6719 - DNA, 19 bp, Artificial Sequence
  Description of Artificial Sequence: Chemically synthesized oligonucleotide
cgtgtggcaggcactgggc

SEQ ID NO: 6720 - DNA, 19 bp, Artificial Sequence
  Description of Artificial Sequence: Chemically synthesized oligonucleotide
gcccagtgcctgccacacg

SEQ ID NO: 6721 - DNA, 19 bp, Artificial Sequence
  Description of Artificial Sequence: Chemically synthesized oligonucleotide
gtgtggcaggcactgggcg

SEQ ID NO: 6722 - DNA, 19 bp, Artificial Sequence
  Description of Artificial Sequence: Chemically synthesized oligonucleotide
cgcccagtgcctgccacac

SEQ ID NO: 6723 - DNA, 19 bp, Artificial Sequence
  Description of Artificial Sequence: Chemically synthesized oligonucleotide
tgtggcaggcactgggcgg

SEQ ID NO: 6724 - DNA, 19 bp, Artificial Sequence
  Description of Artificial Sequence: Chemically synthesized oligonucleotide
ccgcccagtgcctgccaca

SEQ ID NO: 6725 - DNA, 19 bp, Artificial Sequence
  Description of Artificial Sequence: Chemically synthesized oligonucleotide
gtggcaggcactgggcggg

SEQ ID NO: 6726 - DNA, 19 bp, Artificial Sequence
  Description of Artificial Sequence: Chemically synthesized oligonucleotide
cccgcccagtgcctgccac

SEQ ID NO: 6727 - DNA, 19 bp, Artificial Sequence
  Description of Artificial Sequence: Chemically synthesized oligonucleotide
tggcaggcactgggcgggc

SEQ ID NO: 6728 - DNA, 19 bp, Artificial Sequence
  Description of Artificial Sequence: Chemically synthesized oligonucleotide
gcccgcccagtgcctgcca

SEQ ID NO: 6729 - DNA, 19 bp, Artificial Sequence
  Description of Artificial Sequence: Chemically synthesized oligonucleotide
ggcaggcactgggcgggcc

SEQ ID NO: 6730 - DNA, 19 bp, Artificial Sequence
  Description of Artificial Sequence: Chemically synthesized oligonucleotide
ggcccgcccagtgcctgcc

SEQ ID NO: 6731 - DNA, 19 bp, Artificial Sequence
  Description of Artificial Sequence: Chemically synthesized oligonucleotide
gcaggcactgggcgggcca

SEQ ID NO: 6732 - DNA, 19 bp, Artificial Sequence
  Description of Artificial Sequence: Chemically synthesized oligonucleotide
tggcccgcccagtgcctgc

SEQ ID NO: 6733 - DNA, 19 bp, Artificial Sequence
  Description of Artificial Sequence: Chemically synthesized oligonucleotide
caggcactgggcgggccag

SEQ ID NO: 6734 - DNA, 19 bp, Artificial Sequence
  Description of Artificial Sequence: Chemically synthesized oligonucleotide
ctggcccgcccagtgcctg

SEQ ID NO: 6735 - DNA, 19 bp, Artificial Sequence
  Description of Artificial Sequence: Chemically synthesized oligonucleotide
aggcactgggcgggccagg

SEQ ID NO: 6736 - DNA, 19 bp, Artificial Sequence
  Description of Artificial Sequence: Chemically synthesized oligonucleotide
cctggcccgcccagtgcct

SEQ ID NO: 6737 - DNA, 19 bp, Artificial Sequence
  Description of Artificial Sequence: Chemically synthesized oligonucleotide
ggcactgggcgggccaggg

SEQ ID NO: 6738 - DNA, 19 bp, Artificial Sequence
  Description of Artificial Sequence: Chemically synthesized oligonucleotide
ccctggcccgcccagtgcc

SEQ ID NO: 6739 - DNA, 19 bp, Artificial Sequence
  Description of Artificial Sequence: Chemically synthesized oligonucleotide
gcactgggcgggccaggga

SEQ ID NO: 6740 - DNA, 19 bp, Artificial Sequence
  Description of Artificial Sequence: Chemically synthesized oligonucleotide
tccctggcccgcccagtgc

SEQ ID NO: 6741 - DNA, 19 bp, Artificial Sequence
  Description of Artificial Sequence: Chemically synthesized oligonucleotide
cactgggcgggccagggag

SEQ ID NO: 6742 - DNA, 19 bp, Artificial Sequence
  Description of Artificial Sequence: Chemically synthesized oligonucleotide
ctccctggcccgcccagtg

SEQ ID NO: 6743 - DNA, 19 bp, Artificial Sequence
  Description of Artificial Sequence: Chemically synthesized oligonucleotide
actgggcgggccagggaga

SEQ ID NO: 6744 - DNA, 19 bp, Artificial Sequence
  Description of Artificial Sequence: Chemically synthesized oligonucleotide
tctccctggcccgcccagt

SEQ ID NO: 6745 - DNA, 19 bp, Artificial Sequence
  Description of Artificial Sequence: Chemically synthesized oligonucleotide
ctgggcgggccagggagaa

SEQ ID NO: 6746 - DNA, 19 bp, Artificial Sequence
  Description of Artificial Sequence: Chemically synthesized oligonucleotide
ttctccctggcccgcccag

SEQ ID NO: 6747 - DNA, 19 bp, Artificial Sequence
  Description of Artificial Sequence: Chemically synthesized oligonucleotide
tgggcgggccagggagaaa

SEQ ID NO: 6748 - DNA, 19 bp, Artificial Sequence
  Description of Artificial Sequence: Chemically synthesized oligonucleotide
tttctccctggcccgccca

SEQ ID NO: 6749 - DNA, 19 bp, Artificial Sequence
  Description of Artificial Sequence: Chemically synthesized oligonucleotide
gggcgggccagggagaaag

SEQ ID NO: 6750 - DNA, 19 bp, Artificial Sequence
  Description of Artificial Sequence: Chemically synthesized oligonucleotide
ctttctccctggcccgccc

SEQ ID NO: 6751 - DNA, 19 bp, Artificial Sequence
  Description of Artificial Sequence: Chemically synthesized oligonucleotide
ggcgggccagggagaaagc

SEQ ID NO: 6752 - DNA, 19 bp, Artificial Sequence
  Description of Artificial Sequence: Chemically synthesized oligonucleotide
gctttctccctggcccgcc

SEQ ID NO: 6753 - DNA, 19 bp, Artificial Sequence
  Description of Artificial Sequence: Chemically synthesized oligonucleotide
gcgggccagggagaaagca

SEQ ID NO: 6754 - DNA, 19 bp, Artificial Sequence
  Description of Artificial Sequence: Chemically synthesized oligonucleotide
tgctttctccctggcccgc

SEQ ID NO: 6755 - DNA, 19 bp, Artificial Sequence
  Description of Artificial Sequence: Chemically synthesized oligonucleotide
cgggccagggagaaagcag

SEQ ID NO: 6756 - DNA, 19 bp, Artificial Sequence
  Description of Artificial Sequence: Chemically synthesized oligonucleotide
ctgctttctccctggcccg

SEQ ID NO: 6757 - DNA, 19 bp, Artificial Sequence
  Description of Artificial Sequence: Chemically synthesized oligonucleotide
gggccagggagaaagcagg

SEQ ID NO: 6758 - DNA, 19 bp, Artificial Sequence
  Description of Artificial Sequence: Chemically synthesized oligonucleotide
cctgctttctccctggccc

SEQ ID NO: 6759 - DNA, 19 bp, Artificial Sequence
  Description of Artificial Sequence: Chemically synthesized oligonucleotide
ggccagggagaaagcaggc

SEQ ID NO: 6760 - DNA, 19 bp, Artificial Sequence
  Description of Artificial Sequence: Chemically synthesized oligonucleotide
gcctgctttctccctggcc

SEQ ID NO: 6761 - DNA, 19 bp, Artificial Sequence
  Description of Artificial Sequence: Chemically synthesized oligonucleotide
gccagggagaaagcaggct

SEQ ID NO: 6762 - DNA, 19 bp, Artificial Sequence
  Description of Artificial Sequence: Chemically synthesized oligonucleotide
agcctgctttctccctggc

SEQ ID NO: 6763 - DNA, 19 bp, Artificial Sequence
  Description of Artificial Sequence: Chemically synthesized oligonucleotide
ccagggagaaagcaggctt

SEQ ID NO: 6764 - DNA, 19 bp, Artificial Sequence
  Description of Artificial Sequence: Chemically synthesized oligonucleotide
aagcctgctttctccctgg

SEQ ID NO: 6765 - DNA, 19 bp, Artificial Sequence
  Description of Artificial Sequence: Chemically synthesized oligonucleotide
cagggagaaagcaggcttt

SEQ ID NO: 6766 - DNA, 19 bp, Artificial Sequence
  Description of Artificial Sequence: Chemically synthesized oligonucleotide
aaagcctgctttctccctg

SEQ ID NO: 6767 - DNA, 19 bp, Artificial Sequence
  Description of Artificial Sequence: Chemically synthesized oligonucleotide
agggagaaagcaggctttc

SEQ ID NO: 6768 - DNA, 19 bp, Artificial Sequence
  Description of Artificial Sequence: Chemically synthesized oligonucleotide
gaaagcctgctttctccct

SEQ ID NO: 6769 - DNA, 19 bp, Artificial Sequence
  Description of Artificial Sequence: Chemically synthesized oligonucleotide
gggagaaagcaggctttca

SEQ ID NO: 6770 - DNA, 19 bp, Artificial Sequence
  Description of Artificial Sequence: Chemically synthesized oligonucleotide
tgaaagcctgctttctccc

SEQ ID NO: 6771 - DNA, 19 bp, Artificial Sequence
  Description of Artificial Sequence: Chemically synthesized oligonucleotide
ggagaaagcaggctttcag

SEQ ID NO: 6772 - DNA, 19 bp, Artificial Sequence
  Description of Artificial Sequence: Chemically synthesized oligonucleotide
ctgaaagcctgctttctcc

SEQ ID NO: 6773 - DNA, 19 bp, Artificial Sequence
  Description of Artificial Sequence: Chemically synthesized oligonucleotide
gagaaagcaggctttcagg

SEQ ID NO: 6774 - DNA, 19 bp, Artificial Sequence
  Description of Artificial Sequence: Chemically synthesized oligonucleotide
cctgaaagcctgctttctc

SEQ ID NO: 6775 - DNA, 19 bp, Artificial Sequence
  Description of Artificial Sequence: Chemically synthesized oligonucleotide
agaaagcaggctttcagga

SEQ ID NO: 6776 - DNA, 19 bp, Artificial Sequence
  Description of Artificial Sequence: Chemically synthesized oligonucleotide
tcctgaaagcctgctttct

SEQ ID NO: 6777 - DNA, 19 bp, Artificial Sequence
  Description of Artificial Sequence: Chemically synthesized oligonucleotide
gaaagcaggctttcaggag

SEQ ID NO: 6778 - DNA, 19 bp, Artificial Sequence
  Description of Artificial Sequence: Chemically synthesized oligonucleotide
ctcctgaaagcctgctttc

SEQ ID NO: 6779 - DNA, 19 bp, Artificial Sequence
  Description of Artificial Sequence: Chemically synthesized oligonucleotide
aaagcaggctttcaggagc

SEQ ID NO: 6780 - DNA, 19 bp, Artificial Sequence
  Description of Artificial Sequence: Chemically synthesized oligonucleotide
gctcctgaaagcctgcttt

SEQ ID NO: 6781 - DNA, 19 bp, Artificial Sequence
  Description of Artificial Sequence: Chemically synthesized oligonucleotide
aagcaggctttcaggagca

SEQ ID NO: 6782 - DNA, 19 bp, Artificial Sequence
  Description of Artificial Sequence: Chemically synthesized oligonucleotide
tgctcctgaaagcctgctt

SEQ ID NO: 6783 - DNA, 19 bp, Artificial Sequence
  Description of Artificial Sequence: Chemically synthesized oligonucleotide
agcaggctttcaggagcag

SEQ ID NO: 6784 - DNA, 19 bp, Artificial Sequence
  Description of Artificial Sequence: Chemically synthesized oligonucleotide
ctgctcctgaaagcctgct

SEQ ID NO: 6785 - DNA, 19 bp, Artificial Sequence
  Description of Artificial Sequence: Chemically synthesized oligonucleotide
gcaggctttcaggagcagt

SEQ ID NO: 6786 - DNA, 19 bp, Artificial Sequence
  Description of Artificial Sequence: Chemically synthesized oligonucleotide
actgctcctgaaagcctgc

SEQ ID NO: 6787 - DNA, 19 bp, Artificial Sequence
  Description of Artificial Sequence: Chemically synthesized oligonucleotide
caggctttcaggagcagtc

SEQ ID NO: 6788 - DNA, 19 bp, Artificial Sequence
  Description of Artificial Sequence: Chemically synthesized oligonucleotide
gactgctcctgaaagcctg

SEQ ID NO: 6789 - DNA, 19 bp, Artificial Sequence
  Description of Artificial Sequence: Chemically synthesized oligonucleotide
aggctttcaggagcagtcc

SEQ ID NO: 6790 - DNA, 19 bp, Artificial Sequence
  Description of Artificial Sequence: Chemically synthesized oligonucleotide
ggactgctcctgaaagcct

SEQ ID NO: 6791 - DNA, 19 bp, Artificial Sequence
  Description of Artificial Sequence: Chemically synthesized oligonucleotide
ggctttcaggagcagtccg

SEQ ID NO: 6792 - DNA, 19 bp, Artificial Sequence
  Description of Artificial Sequence: Chemically synthesized oligonucleotide
cggactgctcctgaaagcc

SEQ ID NO: 6793 - DNA, 19 bp, Artificial Sequence
  Description of Artificial Sequence: Chemically synthesized oligonucleotide
gctttcaggagcagtccgc

SEQ ID NO: 6794 - DNA, 19 bp, Artificial Sequence
  Description of Artificial Sequence: Chemically synthesized oligonucleotide
gcggactgctcctgaaagc

SEQ ID NO: 6795 - DNA, 19 bp, Artificial Sequence
  Description of Artificial Sequence: Chemically synthesized oligonucleotide
ctttcaggagcagtccgcg

SEQ ID NO: 6796 - DNA, 19 bp, Artificial Sequence
  Description of Artificial Sequence: Chemically synthesized oligonucleotide
cgcggactgctcctgaaag

SEQ ID NO: 6797 - DNA, 19 bp, Artificial Sequence
  Description of Artificial Sequence: Chemically synthesized oligonucleotide
tttcaggagcagtccgcgg

SEQ ID NO: 6798 - DNA, 19 bp, Artificial Sequence
  Description of Artificial Sequence: Chemically synthesized oligonucleotide
ccgcggactgctcctgaaa

SEQ ID NO: 6799 - DNA, 19 bp, Artificial Sequence
  Description of Artificial Sequence: Chemically synthesized oligonucleotide
ttcaggagcagtccgcgga

SEQ ID NO: 6800 - DNA, 19 bp, Artificial Sequence
  Description of Artificial Sequence: Chemically synthesized oligonucleotide
tccgcggactgctcctgaa

SEQ ID NO: 6801 - DNA, 19 bp, Artificial Sequence
  Description of Artificial Sequence: Chemically synthesized oligonucleotide
tcaggagcagtccgcggag

SEQ ID NO: 6802 - DNA, 19 bp, Artificial Sequence
  Description of Artificial Sequence: Chemically synthesized oligonucleotide
ctccgcggactgctcctga

SEQ ID NO: 6803 - DNA, 19 bp, Artificial Sequence
  Description of Artificial Sequence: Chemically synthesized oligonucleotide
caggagcagtccgcggagg

SEQ ID NO: 6804 - DNA, 19 bp, Artificial Sequence
  Description of Artificial Sequence: Chemically synthesized oligonucleotide
cctccgcggactgctcctg

SEQ ID NO: 6805 - DNA, 19 bp, Artificial Sequence
  Description of Artificial Sequence: Chemically synthesized oligonucleotide
aggagcagtccgcggagga

SEQ ID NO: 6806 - DNA, 19 bp, Artificial Sequence
  Description of Artificial Sequence: Chemically synthesized oligonucleotide
tcctccgcggactgctcct

SEQ ID NO: 6807 - DNA, 19 bp, Artificial Sequence
  Description of Artificial Sequence: Chemically synthesized oligonucleotide
ggagcagtccgcggaggag

SEQ ID NO: 6808 - DNA, 19 bp, Artificial Sequence
  Description of Artificial Sequence: Chemically synthesized oligonucleotide
ctcctccgcggactgctcc

SEQ ID NO: 6809 - DNA, 19 bp, Artificial Sequence
  Description of Artificial Sequence: Chemically synthesized oligonucleotide
gagcagtccgcggaggagt

SEQ ID NO: 6810 - DNA, 19 bp, Artificial Sequence
  Description of Artificial Sequence: Chemically synthesized oligonucleotide
actcctccgcggactgctc

SEQ ID NO: 6811 - DNA, 19 bp, Artificial Sequence
  Description of Artificial Sequence: Chemically synthesized oligonucleotide
agcagtccgcggaggagtg

SEQ ID NO: 6812 - DNA, 19 bp, Artificial Sequence
  Description of Artificial Sequence: Chemically synthesized oligonucleotide
cactcctccgcggactgct

SEQ ID NO: 6813 - DNA, 19 bp, Artificial Sequence
  Description of Artificial Sequence: Chemically synthesized oligonucleotide
gcagtccgcggaggagtgc

SEQ ID NO: 6814 - DNA, 19 bp, Artificial Sequence
  Description of Artificial Sequence: Chemically synthesized oligonucleotide
gcactcctccgcggactgc

SEQ ID NO: 6815 - DNA, 19 bp, Artificial Sequence
  Description of Artificial Sequence: Chemically synthesized oligonucleotide
cagtccgcggaggagtgca

SEQ ID NO: 6816 - DNA, 19 bp, Artificial Sequence
  Description of Artificial Sequence: Chemically synthesized oligonucleotide
tgcactcctccgcggactg

SEQ ID NO: 6817 - DNA, 19 bp, Artificial Sequence
  Description of Artificial Sequence: Chemically synthesized oligonucleotide
agtccgcggaggagtgcac

SEQ ID NO: 6818 - DNA, 19 bp, Artificial Sequence
  Description of Artificial Sequence: Chemically synthesized oligonucleotide
gtgcactcctccgcggact

SEQ ID NO: 6819 - DNA, 19 bp, Artificial Sequence
  Description of Artificial Sequence: Chemically synthesized oligonucleotide
gtccgcggaggagtgcacg

SEQ ID NO: 6820 - DNA, 19 bp, Artificial Sequence
  Description of Artificial Sequence: Chemically synthesized oligonucleotide
cgtgcactcctccgcggac

SEQ ID NO: 6821 - DNA, 19 bp, Artificial Sequence
  Description of Artificial Sequence: Chemically synthesized oligonucleotide
tccgcggaggagtgcacgc

SEQ ID NO: 6822 - DNA, 19 bp, Artificial Sequence
  Description of Artificial Sequence: Chemically synthesized oligonucleotide
gcgtgcactcctccgcgga

SEQ ID NO: 6823 - DNA, 19 bp, Artificial Sequence
  Description of Artificial Sequence: Chemically synthesized oligonucleotide
ccgcggaggagtgcacgca

SEQ ID NO: 6824 - DNA, 19 bp, Artificial Sequence
  Description of Artificial Sequence: Chemically synthesized oligonucleotide
tgcgtgcactcctccgcgg

SEQ ID NO: 6825 - DNA, 19 bp, Artificial Sequence
  Description of Artificial Sequence: Chemically synthesized oligonucleotide
cgcggaggagtgcacgcag

SEQ ID NO: 6826 - DNA, 19 bp, Artificial Sequence
  Description of Artificial Sequence: Chemically synthesized oligonucleotide
ctgcgtgcactcctccgcg

SEQ ID NO: 6827 - DNA, 19 bp, Artificial Sequence
  Description of Artificial Sequence: Chemically synthesized oligonucleotide
gcggaggagtgcacgcagg

SEQ ID NO: 6828 - DNA, 19 bp, Artificial Sequence
  Description of Artificial Sequence: Chemically synthesized oligonucleotide
cctgcgtgcactcctccgc

SEQ ID NO: 6829 - DNA, 19 bp, Artificial Sequence
  Description of Artificial Sequence: Chemically synthesized oligonucleotide
cggaggagtgcacgcagga

SEQ ID NO: 6830 - DNA, 19 bp, Artificial Sequence
  Description of Artificial Sequence: Chemically synthesized oligonucleotide
tcctgcgtgcactcctccg

SEQ ID NO: 6831 - DNA, 19 bp, Artificial Sequence
  Description of Artificial Sequence: Chemically synthesized oligonucleotide
ggaggagtgcacgcaggag

SEQ ID NO: 6832 - DNA, 19 bp, Artificial Sequence
  Description of Artificial Sequence: Chemically synthesized oligonucleotide
ctcctgcgtgcactcctcc

SEQ ID NO: 6833 - DNA, 19 bp, Artificial Sequence
  Description of Artificial Sequence: Chemically synthesized oligonucleotide
gaggagtgcacgcaggagg

SEQ ID NO: 6834 - DNA, 19 bp, Artificial Sequence
  Description of Artificial Sequence: Chemically synthesized oligonucleotide
cctcctgcgtgcactcctc

SEQ ID NO: 6835 - DNA, 19 bp, Artificial Sequence
  Description of Artificial Sequence: Chemically synthesized oligonucleotide
aggagtgcacgcaggaggc

SEQ ID NO: 6836 - DNA, 19 bp, Artificial Sequence
  Description of Artificial Sequence: Chemically synthesized oligonucleotide
gcctcctgcgtgcactcct

SEQ ID NO: 6837 - DNA, 19 bp, Artificial Sequence
  Description of Artificial Sequence: Chemically synthesized oligonucleotide
ggagtgcacgcaggaggcc

SEQ ID NO: 6838 - DNA, 19 bp, Artificial Sequence
  Description of Artificial Sequence: Chemically synthesized oligonucleotide
ggcctcctgcgtgcactcc

SEQ ID NO: 6839 - DNA, 19 bp, Artificial Sequence
  Description of Artificial Sequence: Chemically synthesized oligonucleotide
gagtgcacgcaggaggccg

SEQ ID NO: 6840 - DNA, 19 bp, Artificial Sequence
  Description of Artificial Sequence: Chemically synthesized oligonucleotide
cggcctcctgcgtgcactc

SEQ ID NO: 6841 - DNA, 19 bp, Artificial Sequence
  Description of Artificial Sequence: Chemically synthesized oligonucleotide
agtgcacgcaggaggccgg

SEQ ID NO: 6842 - DNA, 19 bp, Artificial Sequence
  Description of Artificial Sequence: Chemically synthesized oligonucleotide
ccggcctcctgcgtgcact

SEQ ID NO: 6843 - DNA, 19 bp, Artificial Sequence
  Description of Artificial Sequence: Chemically synthesized oligonucleotide
gtgcacgcaggaggccggg

SEQ ID NO: 6844 - DNA, 19 bp, Artificial Sequence
  Description of Artificial Sequence: Chemically synthesized oligonucleotide
cccggcctcctgcgtgcac

SEQ ID NO: 6845 - DNA, 19 bp, Artificial Sequence
  Description of Artificial Sequence: Chemically synthesized oligonucleotide
tgcacgcaggaggccgggc

SEQ ID NO: 6846 - DNA, 19 bp, Artificial Sequence
  Description of Artificial Sequence: Chemically synthesized oligonucleotide
gcccggcctcctgcgtgca

SEQ ID NO: 6847 - DNA, 19 bp, Artificial Sequence
  Description of Artificial Sequence: Chemically synthesized oligonucleotide
gcacgcaggaggccgggca

SEQ ID NO: 6848 - DNA, 19 bp, Artificial Sequence
  Description of Artificial Sequence: Chemically synthesized oligonucleotide
tgcccggcctcctgcgtgc

SEQ ID NO: 6849 - DNA, 19 bp, Artificial Sequence
  Description of Artificial Sequence: Chemically synthesized oligonucleotide
cacgcaggaggccgggcac

SEQ ID NO: 6850 - DNA, 19 bp, Artificial Sequence
  Description of Artificial Sequence: Chemically synthesized oligonucleotide
gtgcccggcctcctgcgtg

SEQ ID NO: 6851 - DNA, 19 bp, Artificial Sequence
  Description of Artificial Sequence: Chemically synthesized oligonucleotide
acgcaggaggccgggcacg

SEQ ID NO: 6852 - DNA, 19 bp, Artificial Sequence
  Description of Artificial Sequence: Chemically synthesized oligonucleotide
cgtgcccggcctcctgcgt

SEQ ID NO: 6853 - DNA, 19 bp, Artificial Sequence
  Description of Artificial Sequence: Chemically synthesized oligonucleotide
cgcaggaggccgggcacgc

SEQ ID NO: 6854 - DNA, 19 bp, Artificial Sequence
  Description of Artificial Sequence: Chemically synthesized oligonucleotide
gcgtgcccggcctcctgcg

SEQ ID NO: 6855 - DNA, 19 bp, Artificial Sequence
  Description of Artificial Sequence: Chemically synthesized oligonucleotide
gcaggaggccgggcacgct

SEQ ID NO: 6856 - DNA, 19 bp, Artificial Sequence
  Description of Artificial Sequence: Chemically synthesized oligonucleotide
agcgtgcccggcctcctgc

SEQ ID NO: 6857 - DNA, 19 bp, Artificial Sequence
  Description of Artificial Sequence: Chemically synthesized oligonucleotide
caggaggccgggcacgctg

SEQ ID NO: 6858 - DNA, 19 bp, Artificial Sequence
  Description of Artificial Sequence: Chemically synthesized oligonucleotide
cagcgtgcccggcctcctg

SEQ ID NO: 6859 - DNA, 19 bp, Artificial Sequence
  Description of Artificial Sequence: Chemically synthesized oligonucleotide
aggaggccgggcacgctgc

SEQ ID NO: 6860 - DNA, 19 bp, Artificial Sequence
  Description of Artificial Sequence: Chemically synthesized oligonucleotide
gcagcgtgcccggcctcct

SEQ ID NO: 6861 - DNA, 19 bp, Artificial Sequence
  Description of Artificial Sequence: Chemically synthesized oligonucleotide
ggaggccgggcacgctgcc

SEQ ID NO: 6862 - DNA, 19 bp, Artificial Sequence
  Description of Artificial Sequence: Chemically synthesized oligonucleotide
ggcagcgtgcccggcctcc

SEQ ID NO: 6863 - DNA, 19 bp, Artificial Sequence
  Description of Artificial Sequence: Chemically synthesized oligonucleotide
gaggccgggcacgctgcct

SEQ ID NO: 6864 - DNA, 19 bp, Artificial Sequence
  Description of Artificial Sequence: Chemically synthesized oligonucleotide
aggcagcgtgcccggcctc

SEQ ID NO: 6865 - DNA, 19 bp, Artificial Sequence
  Description of Artificial Sequence: Chemically synthesized oligonucleotide
aggccgggcacgctgcctg

SEQ ID NO: 6866 - DNA, 19 bp, Artificial Sequence
  Description of Artificial Sequence: Chemically synthesized oligonucleotide
caggcagcgtgcccggcct

SEQ ID NO: 6867 - DNA, 19 bp, Artificial Sequence
  Description of Artificial Sequence: Chemically synthesized oligonucleotide
ggccgggcacgctgcctgt

SEQ ID NO: 6868 - DNA, 19 bp, Artificial Sequence
  Description of Artificial Sequence: Chemically synthesized oligonucleotide
acaggcagcgtgcccggcc

SEQ ID NO: 6869 - DNA, 19 bp, Artificial Sequence
  Description of Artificial Sequence: Chemically synthesized oligonucleotide
gccgggcacgctgcctgtt

SEQ ID NO: 6870 - DNA, 19 bp, Artificial Sequence
  Description of Artificial Sequence: Chemically synthesized oligonucleotide
aacaggcagcgtgcccggc

SEQ ID NO: 6871 - DNA, 19 bp, Artificial Sequence
  Description of Artificial Sequence: Chemically synthesized oligonucleotide
ccgggcacgctgcctgttc

SEQ ID NO: 6872 - DNA, 19 bp, Artificial Sequence
  Description of Artificial Sequence: Chemically synthesized oligonucleotide
gaacaggcagcgtgcccgg

SEQ ID NO: 6873 - DNA, 19 bp, Artificial Sequence
  Description of Artificial Sequence: Chemically synthesized oligonucleotide
cgggcacgctgcctgttcc

SEQ ID NO: 6874 - DNA, 19 bp, Artificial Sequence
  Description of Artificial Sequence: Chemically synthesized oligonucleotide
ggaacaggcagcgtgcccg

SEQ ID NO: 6875 - DNA, 19 bp, Artificial Sequence
  Description of Artificial Sequence: Chemically synthesized oligonucleotide
gggcacgctgcctgttccc

SEQ ID NO: 6876 - DNA, 19 bp, Artificial Sequence
  Description of Artificial Sequence: Chemically synthesized oligonucleotide
gggaacaggcagcgtgccc

SEQ ID NO: 6877 - DNA, 19 bp, Artificial Sequence
  Description of Artificial Sequence: Chemically synthesized oligonucleotide
ggcacgctgcctgttccct

SEQ ID NO: 6878 - DNA, 19 bp, Artificial Sequence
  Description of Artificial Sequence: Chemically synthesized oligonucleotide
agggaacaggcagcgtgcc

SEQ ID NO: 6879 - DNA, 19 bp, Artificial Sequence
  Description of Artificial Sequence: Chemically synthesized oligonucleotide
gcacgctgcctgttccctg

SEQ ID NO: 6880 - DNA, 19 bp, Artificial Sequence
  Description of Artificial Sequence: Chemically synthesized oligonucleotide
cagggaacaggcagcgtgc

SEQ ID NO: 6881 - DNA, 19 bp, Artificial Sequence
  Description of Artificial Sequence: Chemically synthesized oligonucleotide
cacgctgcctgttccctga

SEQ ID NO: 6882 - DNA, 19 bp, Artificial Sequence
  Description of Artificial Sequence: Chemically synthesized oligonucleotide
tcagggaacaggcagcgtg

SEQ ID NO: 6883 - DNA, 19 bp, Artificial Sequence
  Description of Artificial Sequence: Chemically synthesized oligonucleotide
acgctgcctgttccctgat

SEQ ID NO: 6884 - DNA, 19 bp, Artificial Sequence
  Description of Artificial Sequence: Chemically synthesized oligonucleotide
atcagggaacaggcagcgt

SEQ ID NO: 6885 - DNA, 19 bp, Artificial Sequence
  Description of Artificial Sequence: Chemically synthesized oligonucleotide
cgctgcctgttccctgatg

SEQ ID NO: 6886 - DNA, 19 bp, Artificial Sequence
  Description of Artificial Sequence: Chemically synthesized oligonucleotide
catcagggaacaggcagcg

SEQ ID NO: 6887 - DNA, 19 bp, Artificial Sequence
  Description of Artificial Sequence: Chemically synthesized oligonucleotide
gctgcctgttccctgatgc

SEQ ID NO: 6888 - DNA, 19 bp, Artificial Sequence
  Description of Artificial Sequence: Chemically synthesized oligonucleotide
gcatcagggaacaggcagc

SEQ ID NO: 6889 - DNA, 19 bp, Artificial Sequence
  Description of Artificial Sequence: Chemically synthesized oligonucleotide
ctgcctgttccctgatgct

SEQ ID NO: 6890 - DNA, 19 bp, Artificial Sequence
  Description of Artificial Sequence: Chemically synthesized oligonucleotide
agcatcagggaacaggcag

SEQ ID NO: 6891 - DNA, 19 bp, Artificial Sequence
  Description of Artificial Sequence: Chemically synthesized oligonucleotide
tgcctgttccctgatgctg

SEQ ID NO: 6892 - DNA, 19 bp, Artificial Sequence
  Description of Artificial Sequence: Chemically synthesized oligonucleotide
cagcatcagggaacaggca

SEQ ID NO: 6893 - DNA, 19 bp, Artificial Sequence
  Description of Artificial Sequence: Chemically synthesized oligonucleotide
gcctgttccctgatgctga

SEQ ID NO: 6894 - DNA, 19 bp, Artificial Sequence
  Description of Artificial Sequence: Chemically synthesized oligonucleotide
tcagcatcagggaacaggc

SEQ ID NO: 6895 - DNA, 19 bp, Artificial Sequence
  Description of Artificial Sequence: Chemically synthesized oligonucleotide
cctgttccctgatgctgac

SEQ ID NO: 6896 - DNA, 19 bp, Artificial Sequence
  Description of Artificial Sequence: Chemically synthesized oligonucleotide
gtcagcatcagggaacagg

SEQ ID NO: 6897 - DNA, 19 bp, Artificial Sequence
  Description of Artificial Sequence: Chemically synthesized oligonucleotide
ctgttccctgatgctgacc

SEQ ID NO: 6898 - DNA, 19 bp, Artificial Sequence
  Description of Artificial Sequence: Chemically synthesized oligonucleotide
ggtcagcatcagggaacag

SEQ ID NO: 6899 - DNA, 19 bp, Artificial Sequence
  Description of Artificial Sequence: Chemically synthesized oligonucleotide
tgttccctgatgctgaccc

SEQ ID NO: 6900 - DNA, 19 bp, Artificial Sequence
  Description of Artificial Sequence: Chemically synthesized oligonucleotide
gggtcagcatcagggaaca

SEQ ID NO: 6901 - DNA, 19 bp, Artificial Sequence
  Description of Artificial Sequence: Chemically synthesized oligonucleotide
gttccctgatgctgaccca

SEQ ID NO: 6902 - DNA, 19 bp, Artificial Sequence
  Description of Artificial Sequence: Chemically synthesized oligonucleotide
tgggtcagcatcagggaac

SEQ ID NO: 6903 - DNA, 19 bp, Artificial Sequence
  Description of Artificial Sequence: Chemically synthesized oligonucleotide
ttccctgatgctgacccag

SEQ ID NO: 6904 - DNA, 19 bp, Artificial Sequence
  Description of Artificial Sequence: Chemically synthesized oligonucleotide
ctgggtcagcatcagggaa

SEQ ID NO: 6905 - DNA, 19 bp, Artificial Sequence
  Description of Artificial Sequence: Chemically synthesized oligonucleotide
tccctgatgctgacccagt

SEQ ID NO: 6906 - DNA, 19 bp, Artificial Sequence
  Description of Artificial Sequence: Chemically synthesized oligonucleotide
actgggtcagcatcaggga

SEQ ID NO: 6907 - DNA, 19 bp, Artificial Sequence
  Description of Artificial Sequence: Chemically synthesized oligonucleotide
ccctgatgctgacccagtt

SEQ ID NO: 6908 - DNA, 19 bp, Artificial Sequence
  Description of Artificial Sequence: Chemically synthesized oligonucleotide
aactgggtcagcatcaggg

SEQ ID NO: 6909 - DNA, 19 bp, Artificial Sequence
  Description of Artificial Sequence: Chemically synthesized oligonucleotide
cctgatgctgacccagttt

SEQ ID NO: 6910 - DNA, 19 bp, Artificial Sequence
  Description of Artificial Sequence: Chemically synthesized oligonucleotide
aaactgggtcagcatcagg

SEQ ID NO: 6911 - DNA, 19 bp, Artificial Sequence
  Description of Artificial Sequence: Chemically synthesized oligonucleotide
ctgatgctgacccagtttg

SEQ ID NO: 6912 - DNA, 19 bp, Artificial Sequence
  Description of Artificial Sequence: Chemically synthesized oligonucleotide
caaactgggtcagcatcag

SEQ ID NO: 6913 - DNA, 19 bp, Artificial Sequence
  Description of Artificial Sequence: Chemically synthesized oligonucleotide
tgatgctgacccagtttgt

SEQ ID NO: 6914 - DNA, 19 bp, Artificial Sequence
  Description of Artificial Sequence: Chemically synthesized oligonucleotide
acaaactgggtcagcatca

SEQ ID NO: 6915 - DNA, 19 bp, Artificial Sequence
  Description of Artificial Sequence: Chemically synthesized oligonucleotide
gatgctgacccagtttgtc

SEQ ID NO: 6916 - DNA, 19 bp, Artificial Sequence
  Description of Artificial Sequence: Chemically synthesized oligonucleotide
gacaaactgggtcagcatc

SEQ ID NO: 6917 - DNA, 19 bp, Artificial Sequence
  Description of Artificial Sequence: Chemically synthesized oligonucleotide
atgctgacccagtttgtct

SEQ ID NO: 6918 - DNA, 19 bp, Artificial Sequence
  Description of Artificial Sequence: Chemically synthesized oligonucleotide
agacaaactgggtcagcat

SEQ ID NO: 6919 - DNA, 19 bp, Artificial Sequence
  Description of Artificial Sequence: Chemically synthesized oligonucleotide
tgctgacccagtttgtctc

SEQ ID NO: 6920 - DNA, 19 bp, Artificial Sequence
  Description of Artificial Sequence: Chemically synthesized oligonucleotide
gagacaaactgggtcagca

SEQ ID NO: 6921 - DNA, 19 bp, Artificial Sequence
  Description of Artificial Sequence: Chemically synthesized oligonucleotide
gctgacccagtttgtctcc

SEQ ID NO: 6922 - DNA, 19 bp, Artificial Sequence
  Description of Artificial Sequence: Chemically synthesized oligonucleotide
ggagacaaactgggtcagc

SEQ ID NO: 6923 - DNA, 19 bp, Artificial Sequence
  Description of Artificial Sequence: Chemically synthesized oligonucleotide
ctgacccagtttgtctcca

SEQ ID NO: 6924 - DNA, 19 bp, Artificial Sequence
  Description of Artificial Sequence: Chemically synthesized oligonucleotide
tggagacaaactgggtcag

SEQ ID NO: 6925 - DNA, 19 bp, Artificial Sequence
  Description of Artificial Sequence: Chemically synthesized oligonucleotide
tgacccagtttgtctccag

SEQ ID NO: 6926 - DNA, 19 bp, Artificial Sequence
  Description of Artificial Sequence: Chemically synthesized oligonucleotide
ctggagacaaactgggtca

SEQ ID NO: 6927 - DNA, 19 bp, Artificial Sequence
  Description of Artificial Sequence: Chemically synthesized oligonucleotide
gacccagtttgtctccagc

SEQ ID NO: 6928 - DNA, 19 bp, Artificial Sequence
  Description of Artificial Sequence: Chemically synthesized oligonucleotide
gctggagacaaactgggtc

SEQ ID NO: 6929 - DNA, 19 bp, Artificial Sequence
  Description of Artificial Sequence: Chemically synthesized oligonucleotide
acccagtttgtctccagcc

SEQ ID NO: 6930 - DNA, 19 bp, Artificial Sequence
  Description of Artificial Sequence: Chemically synthesized oligonucleotide
ggctggagacaaactgggt

SEQ ID NO: 6931 - DNA, 19 bp, Artificial Sequence
  Description of Artificial Sequence: Chemically synthesized oligonucleotide
cccagtttgtctccagcca

SEQ ID NO: 6932 - DNA, 19 bp, Artificial Sequence
  Description of Artificial Sequence: Chemically synthesized oligonucleotide
tggctggagacaaactggg

SEQ ID NO: 6933 - DNA, 19 bp, Artificial Sequence
  Description of Artificial Sequence: Chemically synthesized oligonucleotide
ccagtttgtctccagccag

SEQ ID NO: 6934 - DNA, 19 bp, Artificial Sequence
  Description of Artificial Sequence: Chemically synthesized oligonucleotide
ctggctggagacaaactgg

SEQ ID NO: 6935 - DNA, 19 bp, Artificial Sequence
  Description of Artificial Sequence: Chemically synthesized oligonucleotide
cagtttgtctccagccagg

SEQ ID NO: 6936 - DNA, 19 bp, Artificial Sequence
  Description of Artificial Sequence: Chemically synthesized oligonucleotide
cctggctggagacaaactg

SEQ ID NO: 6937 - DNA, 19 bp, Artificial Sequence
  Description of Artificial Sequence: Chemically synthesized oligonucleotide
agtttgtctccagccaggc

SEQ ID NO: 6938 - DNA, 19 bp, Artificial Sequence
  Description of Artificial Sequence: Chemically synthesized oligonucleotide
gcctggctggagacaaact

SEQ ID NO: 6939 - DNA, 19 bp, Artificial Sequence
  Description of Artificial Sequence: Chemically synthesized oligonucleotide
gtttgtctccagccaggct

SEQ ID NO: 6940 - DNA, 19 bp, Artificial Sequence
  Description of Artificial Sequence: Chemically synthesized oligonucleotide
agcctggctggagacaaac

SEQ ID NO: 6941 - DNA, 19 bp, Artificial Sequence
  Description of Artificial Sequence: Chemically synthesized oligonucleotide
tttgtctccagccaggctt

SEQ ID NO: 6942 - DNA, 19 bp, Artificial Sequence
  Description of Artificial Sequence: Chemically synthesized oligonucleotide
aagcctggctggagacaaa

SEQ ID NO: 6943 - DNA, 19 bp, Artificial Sequence
  Description of Artificial Sequence: Chemically synthesized oligonucleotide
ttgtctccagccaggcttt

SEQ ID NO: 6944 - DNA, 19 bp, Artificial Sequence
  Description of Artificial Sequence: Chemically synthesized oligonucleotide
aaagcctggctggagacaa

SEQ ID NO: 6945 - DNA, 19 bp, Artificial Sequence
  Description of Artificial Sequence: Chemically synthesized oligonucleotide
tgtctccagccaggctttg

SEQ ID NO: 6946 - DNA, 19 bp, Artificial Sequence
  Description of Artificial Sequence: Chemically synthesized oligonucleotide
caaagcctggctggagaca

SEQ ID NO: 6947 - DNA, 19 bp, Artificial Sequence
  Description of Artificial Sequence: Chemically synthesized oligonucleotide
gtctccagccaggctttgg

SEQ ID NO: 6948 - DNA, 19 bp, Artificial Sequence
  Description of Artificial Sequence: Chemically synthesized oligonucleotide
ccaaagcctggctggagac

SEQ ID NO: 6949 - DNA, 19 bp, Artificial Sequence
  Description of Artificial Sequence: Chemically synthesized oligonucleotide
tctccagccaggctttggc

SEQ ID NO: 6950 - DNA, 19 bp, Artificial Sequence
  Description of Artificial Sequence: Chemically synthesized oligonucleotide
gccaaagcctggctggaga

SEQ ID NO: 6951 - DNA, 19 bp, Artificial Sequence
  Description of Artificial Sequence: Chemically synthesized oligonucleotide
ctccagccaggctttggca

SEQ ID NO: 6952 - DNA, 19 bp, Artificial Sequence
  Description of Artificial Sequence: Chemically synthesized oligonucleotide
tgccaaagcctggctggag

SEQ ID NO: 6953 - DNA, 19 bp, Artificial Sequence
  Description of Artificial Sequence: Chemically synthesized oligonucleotide
tccagccaggctttggcag

SEQ ID NO: 6954 - DNA, 19 bp, Artificial Sequence
  Description of Artificial Sequence: Chemically synthesized oligonucleotide
ctgccaaagcctggctgga

SEQ ID NO: 6955 - DNA, 19 bp, Artificial Sequence
  Description of Artificial Sequence: Chemically synthesized oligonucleotide
ccagccaggctttggcaga

SEQ ID NO: 6956 - DNA, 19 bp, Artificial Sequence
  Description of Artificial Sequence: Chemically synthesized oligonucleotide
tctgccaaagcctggctgg

SEQ ID NO: 6957 - DNA, 19 bp, Artificial Sequence
  Description of Artificial Sequence: Chemically synthesized oligonucleotide
cagccaggctttggcagag

SEQ ID NO: 6958 - DNA, 19 bp, Artificial Sequence
  Description of Artificial Sequence: Chemically synthesized oligonucleotide
ctctgccaaagcctggctg

SEQ ID NO: 6959 - DNA, 19 bp, Artificial Sequence
  Description of Artificial Sequence: Chemically synthesized oligonucleotide
agccaggctttggcagagc

SEQ ID NO: 6960 - DNA, 19 bp, Artificial Sequence
  Description of Artificial Sequence: Chemically synthesized oligonucleotide
gctctgccaaagcctggct

SEQ ID NO: 6961 - DNA, 19 bp, Artificial Sequence
  Description of Artificial Sequence: Chemically synthesized oligonucleotide
gccaggctttggcagagct

SEQ ID NO: 6962 - DNA, 19 bp, Artificial Sequence
  Description of Artificial Sequence: Chemically synthesized oligonucleotide
agctctgccaaagcctggc

SEQ ID NO: 6963 - DNA, 19 bp, Artificial Sequence
  Description of Artificial Sequence: Chemically synthesized oligonucleotide
ccaggctttggcagagctg

SEQ ID NO: 6964 - DNA, 19 bp, Artificial Sequence
  Description of Artificial Sequence: Chemically synthesized oligonucleotide
cagctctgccaaagcctgg

SEQ ID NO: 6965 - DNA, 19 bp, Artificial Sequence
  Description of Artificial Sequence: Chemically synthesized oligonucleotide
caggctttggcagagctga

SEQ ID NO: 6966 - DNA, 19 bp, Artificial Sequence
  Description of Artificial Sequence: Chemically synthesized oligonucleotide
tcagctctgccaaagcctg

SEQ ID NO: 6967 - DNA, 19 bp, Artificial Sequence
  Description of Artificial Sequence: Chemically synthesized oligonucleotide
aggctttggcagagctgag

SEQ ID NO: 6968 - DNA, 19 bp, Artificial Sequence
  Description of Artificial Sequence: Chemically synthesized oligonucleotide
ctcagctctgccaaagcct

SEQ ID NO: 6969 - DNA, 19 bp, Artificial Sequence
  Description of Artificial Sequence: Chemically synthesized oligonucleotide
ggctttggcagagctgagc

SEQ ID NO: 6970 - DNA, 19 bp, Artificial Sequence
  Description of Artificial Sequence: Chemically synthesized oligonucleotide
gctcagctctgccaaagcc

SEQ ID NO: 6971 - DNA, 19 bp, Artificial Sequence
  Description of Artificial Sequence: Chemically synthesized oligonucleotide
gctttggcagagctgagca

SEQ ID NO: 6972 - DNA, 19 bp, Artificial Sequence
  Description of Artificial Sequence: Chemically synthesized oligonucleotide
tgctcagctctgccaaagc

SEQ ID NO: 6973 - DNA, 19 bp, Artificial Sequence
  Description of Artificial Sequence: Chemically synthesized oligonucleotide
ctttggcagagctgagcac

SEQ ID NO: 6974 - DNA, 19 bp, Artificial Sequence
  Description of Artificial Sequence: Chemically synthesized oligonucleotide
gtgctcagctctgccaaag

SEQ ID NO: 6975 - DNA, 19 bp, Artificial Sequence
  Description of Artificial Sequence: Chemically synthesized oligonucleotide
tttggcagagctgagcact

SEQ ID NO: 6976 - DNA, 19 bp, Artificial Sequence
  Description of Artificial Sequence: Chemically synthesized oligonucleotide
agtgctcagctctgccaaa

SEQ ID NO: 6977 - DNA, 19 bp, Artificial Sequence
  Description of Artificial Sequence: Chemically synthesized oligonucleotide
ttggcagagctgagcactg

SEQ ID NO: 6978 - DNA, 19 bp, Artificial Sequence
  Description of Artificial Sequence: Chemically synthesized oligonucleotide
cagtgctcagctctgccaa

SEQ ID NO: 6979 - DNA, 19 bp, Artificial Sequence
  Description of Artificial Sequence: Chemically synthesized oligonucleotide
tggcagagctgagcactgc

SEQ ID NO: 6980 - DNA, 19 bp, Artificial Sequence
  Description of Artificial Sequence: Chemically synthesized oligonucleotide
gcagtgctcagctctgcca

SEQ ID NO: 6981 - DNA, 19 bp, Artificial Sequence
  Description of Artificial Sequence: Chemically synthesized oligonucleotide
ggcagagctgagcactgca

SEQ ID NO: 6982 - DNA, 19 bp, Artificial Sequence
  Description of Artificial Sequence: Chemically synthesized oligonucleotide
tgcagtgctcagctctgcc

SEQ ID NO: 6983 - DNA, 19 bp, Artificial Sequence
  Description of Artificial Sequence: Chemically synthesized oligonucleotide
gcagagctgagcactgcaa

SEQ ID NO: 6984 - DNA, 19 bp, Artificial Sequence
  Description of Artificial Sequence: Chemically synthesized oligonucleotide
ttgcagtgctcagctctgc

SEQ ID NO: 6985 - DNA, 19 bp, Artificial Sequence
  Description of Artificial Sequence: Chemically synthesized oligonucleotide
cagagctgagcactgcaat

SEQ ID NO: 6986 - DNA, 19 bp, Artificial Sequence
  Description of Artificial Sequence: Chemically synthesized oligonucleotide
attgcagtgctcagctctg

SEQ ID NO: 6987 - DNA, 19 bp, Artificial Sequence
  Description of Artificial Sequence: Chemically synthesized oligonucleotide
agagctgagcactgcaatg

SEQ ID NO: 6988 - DNA, 19 bp, Artificial Sequence
  Description of Artificial Sequence: Chemically synthesized oligonucleotide
cattgcagtgctcagctct

SEQ ID NO: 6989 - DNA, 19 bp, Artificial Sequence
  Description of Artificial Sequence: Chemically synthesized oligonucleotide
gagctgagcactgcaatgc

SEQ ID NO: 6990 - DNA, 19 bp, Artificial Sequence
  Description of Artificial Sequence: Chemically synthesized oligonucleotide
gcattgcagtgctcagctc

SEQ ID NO: 6991 - DNA, 19 bp, Artificial Sequence
  Description of Artificial Sequence: Chemically synthesized oligonucleotide
agctgagcactgcaatgca

SEQ ID NO: 6992 - DNA, 19 bp, Artificial Sequence
  Description of Artificial Sequence: Chemically synthesized oligonucleotide
tgcattgcagtgctcagct

SEQ ID NO: 6993 - DNA, 19 bp, Artificial Sequence
  Description of Artificial Sequence: Chemically synthesized oligonucleotide
gctgagcactgcaatgcac

SEQ ID NO: 6994 - DNA, 19 bp, Artificial Sequence
  Description of Artificial Sequence: Chemically synthesized oligonucleotide
gtgcattgcagtgctcagc

SEQ ID NO: 6995 - DNA, 19 bp, Artificial Sequence
  Description of Artificial Sequence: Chemically synthesized oligonucleotide
ctgagcactgcaatgcacc

SEQ ID NO: 6996 - DNA, 19 bp, Artificial Sequence
  Description of Artificial Sequence: Chemically synthesized oligonucleotide
ggtgcattgcagtgctcag

SEQ ID NO: 6997 - DNA, 19 bp, Artificial Sequence
  Description of Artificial Sequence: Chemically synthesized oligonucleotide
tgagcactgcaatgcacca

SEQ ID NO: 6998 - DNA, 19 bp, Artificial Sequence
  Description of Artificial Sequence: Chemically synthesized oligonucleotide
tggtgcattgcagtgctca

SEQ ID NO: 6999 - DNA, 19 bp, Artificial Sequence
  Description of Artificial Sequence: Chemically synthesized oligonucleotide
gagcactgcaatgcaccag

SEQ ID NO: 7000 - DNA, 19 bp, Artificial Sequence
  Description of Artificial Sequence: Chemically synthesized oligonucleotide
ctggtgcattgcagtgctc

SEQ ID NO: 7001 - DNA, 19 bp, Artificial Sequence
  Description of Artificial Sequence: Chemically synthesized oligonucleotide
agcactgcaatgcaccagg

SEQ ID NO: 7002 - DNA, 19 bp, Artificial Sequence
  Description of Artificial Sequence: Chemically synthesized oligonucleotide
cctggtgcattgcagtgct

SEQ ID NO: 7003 - DNA, 19 bp, Artificial Sequence
  Description of Artificial Sequence: Chemically synthesized oligonucleotide
gcactgcaatgcaccaggt

SEQ ID NO: 7004 - DNA, 19 bp, Artificial Sequence
  Description of Artificial Sequence: Chemically synthesized oligonucleotide
acctggtgcattgcagtgc

SEQ ID NO: 7005 - DNA, 19 bp, Artificial Sequence
  Description of Artificial Sequence: Chemically synthesized oligonucleotide
cactgcaatgcaccaggtc

SEQ ID NO: 7006 - DNA, 19 bp, Artificial Sequence
  Description of Artificial Sequence: Chemically synthesized oligonucleotide
gacctggtgcattgcagtg

SEQ ID NO: 7007 - DNA, 19 bp, Artificial Sequence
  Description of Artificial Sequence: Chemically synthesized oligonucleotide
actgcaatgcaccaggtct

SEQ ID NO: 7008 - DNA, 19 bp, Artificial Sequence
  Description of Artificial Sequence: Chemically synthesized oligonucleotide
agacctggtgcattgcagt

SEQ ID NO: 7009 - DNA, 19 bp, Artificial Sequence
  Description of Artificial Sequence: Chemically synthesized oligonucleotide
ctgcaatgcaccaggtctg

SEQ ID NO: 7010 - DNA, 19 bp, Artificial Sequence
  Description of Artificial Sequence: Chemically synthesized oligonucleotide
cagacctggtgcattgcag

SEQ ID NO: 7011 - DNA, 19 bp, Artificial Sequence
  Description of Artificial Sequence: Chemically synthesized oligonucleotide
tgcaatgcaccaggtctgg

SEQ ID NO: 7012 - DNA, 19 bp, Artificial Sequence
  Description of Artificial Sequence: Chemically synthesized oligonucleotide
ccagacctggtgcattgca

SEQ ID NO: 7013 - DNA, 19 bp, Artificial Sequence
  Description of Artificial Sequence: Chemically synthesized oligonucleotide
gcaatgcaccaggtctggg

SEQ ID NO: 7014 - DNA, 19 bp, Artificial Sequence
  Description of Artificial Sequence: Chemically synthesized oligonucleotide
cccagacctggtgcattgc

SEQ ID NO: 7015 - DNA, 19 bp, Artificial Sequence
  Description of Artificial Sequence: Chemically synthesized oligonucleotide
caatgcaccaggtctgggt

SEQ ID NO: 7016 - DNA, 19 bp, Artificial Sequence
  Description of Artificial Sequence: Chemically synthesized oligonucleotide
acccagacctggtgcattg

SEQ ID NO: 7017 - DNA, 19 bp, Artificial Sequence
  Description of Artificial Sequence: Chemically synthesized oligonucleotide
aatgcaccaggtctgggtc

SEQ ID NO: 7018 - DNA, 19 bp, Artificial Sequence
  Description of Artificial Sequence: Chemically synthesized oligonucleotide
gacccagacctggtgcatt

SEQ ID NO: 7019 - DNA, 19 bp, Artificial Sequence
  Description of Artificial Sequence: Chemically synthesized oligonucleotide
atgcaccaggtctgggtca

SEQ ID NO: 7020 - DNA, 19 bp, Artificial Sequence
  Description of Artificial Sequence: Chemically synthesized oligonucleotide
tgacccagacctggtgcat

SEQ ID NO: 7021 - DNA, 19 bp, Artificial Sequence
  Description of Artificial Sequence: Chemically synthesized oligonucleotide
tgcaccaggtctgggtcaa

SEQ ID NO: 7022 - DNA, 19 bp, Artificial Sequence
  Description of Artificial Sequence: Chemically synthesized oligonucleotide
ttgacccagacctggtgca

SEQ ID NO: 7023 - DNA, 19 bp, Artificial Sequence
  Description of Artificial Sequence: Chemically synthesized oligonucleotide
gcaccaggtctgggtcaag

SEQ ID NO: 7024 - DNA, 19 bp, Artificial Sequence
  Description of Artificial Sequence: Chemically synthesized oligonucleotide
cttgacccagacctggtgc

SEQ ID NO: 7025 - DNA, 19 bp, Artificial Sequence
  Description of Artificial Sequence: Chemically synthesized oligonucleotide
caccaggtctgggtcaagt

SEQ ID NO: 7026 - DNA, 19 bp, Artificial Sequence
  Description of Artificial Sequence: Chemically synthesized oligonucleotide
acttgacccagacctggtg

SEQ ID NO: 7027 - DNA, 19 bp, Artificial Sequence
  Description of Artificial Sequence: Chemically synthesized oligonucleotide
accaggtctgggtcaagtt

SEQ ID NO: 7028 - DNA, 19 bp, Artificial Sequence
  Description of Artificial Sequence: Chemically synthesized oligonucleotide
aacttgacccagacctggt

SEQ ID NO: 7029 - DNA, 19 bp, Artificial Sequence
  Description of Artificial Sequence: Chemically synthesized oligonucleotide
ccaggtctgggtcaagttt

SEQ ID NO: 7030 - DNA, 19 bp, Artificial Sequence
  Description of Artificial Sequence: Chemically synthesized oligonucleotide
aaacttgacccagacctgg

SEQ ID NO: 7031 - DNA, 19 bp, Artificial Sequence
  Description of Artificial Sequence: Chemically synthesized oligonucleotide
caggtctgggtcaagtttg

SEQ ID NO: 7032 - DNA, 19 bp, Artificial Sequence
  Description of Artificial Sequence: Chemically synthesized oligonucleotide
caaacttgacccagacctg

SEQ ID NO: 7033 - DNA, 19 bp, Artificial Sequence
  Description of Artificial Sequence: Chemically synthesized oligonucleotide
aggtctgggtcaagtttga

SEQ ID NO: 7034 - DNA, 19 bp, Artificial Sequence
  Description of Artificial Sequence: Chemically synthesized oligonucleotide
tcaaacttgacccagacct

SEQ ID NO: 7035 - DNA, 19 bp, Artificial Sequence
  Description of Artificial Sequence: Chemically synthesized oligonucleotide
ggtctgggtcaagtttgat

SEQ ID NO: 7036 - DNA, 19 bp, Artificial Sequence
  Description of Artificial Sequence: Chemically synthesized oligonucleotide
atcaaacttgacccagacc

SEQ ID NO: 7037 - DNA, 19 bp, Artificial Sequence
  Description of Artificial Sequence: Chemically synthesized oligonucleotide
gtctgggtcaagtttgata

SEQ ID NO: 7038 - DNA, 19 bp, Artificial Sequence
  Description of Artificial Sequence: Chemically synthesized oligonucleotide
tatcaaacttgacccagac

SEQ ID NO: 7039 - DNA, 19 bp, Artificial Sequence
  Description of Artificial Sequence: Chemically synthesized oligonucleotide
tctgggtcaagtttgatat

SEQ ID NO: 7040 - DNA, 19 bp, Artificial Sequence
  Description of Artificial Sequence: Chemically synthesized oligonucleotide
atatcaaacttgacccaga

SEQ ID NO: 7041 - DNA, 19 bp, Artificial Sequence
  Description of Artificial Sequence: Chemically synthesized oligonucleotide
ctgggtcaagtttgatatc

SEQ ID NO: 7042 - DNA, 19 bp, Artificial Sequence
  Description of Artificial Sequence: Chemically synthesized oligonucleotide
gatatcaaacttgacccag

SEQ ID NO: 7043 - DNA, 19 bp, Artificial Sequence
  Description of Artificial Sequence: Chemically synthesized oligonucleotide
tgggtcaagtttgatatcc

SEQ ID NO: 7044 - DNA, 19 bp, Artificial Sequence
  Description of Artificial Sequence: Chemically synthesized oligonucleotide
ggatatcaaacttgaccca

SEQ ID NO: 7045 - DNA, 19 bp, Artificial Sequence
  Description of Artificial Sequence: Chemically synthesized oligonucleotide
gggtcaagtttgatatccg

SEQ ID NO: 7046 - DNA, 19 bp, Artificial Sequence
  Description of Artificial Sequence: Chemically synthesized oligonucleotide
cggatatcaaacttgaccc

SEQ ID NO: 7047 - DNA, 19 bp, Artificial Sequence
  Description of Artificial Sequence: Chemically synthesized oligonucleotide
ggtcaagtttgatatccgg

SEQ ID NO: 7048 - DNA, 19 bp, Artificial Sequence
  Description of Artificial Sequence: Chemically synthesized oligonucleotide
ccggatatcaaacttgacc

SEQ ID NO: 7049 - DNA, 19 bp, Artificial Sequence
  Description of Artificial Sequence: Chemically synthesized oligonucleotide
gtcaagtttgatatccggg

SEQ ID NO: 7050 - DNA, 19 bp, Artificial Sequence
  Description of Artificial Sequence: Chemically synthesized oligonucleotide
cccggatatcaaacttgac

SEQ ID NO: 7051 - DNA, 19 bp, Artificial Sequence
  Description of Artificial Sequence: Chemically synthesized oligonucleotide
tcaagtttgatatccgggg

SEQ ID NO: 7052 - DNA, 19 bp, Artificial Sequence
  Description of Artificial Sequence: Chemically synthesized oligonucleotide
ccccggatatcaaacttga

SEQ ID NO: 7053 - DNA, 19 bp, Artificial Sequence
  Description of Artificial Sequence: Chemically synthesized oligonucleotide
caagtttgatatccggggg

SEQ ID NO: 7054 - DNA, 19 bp, Artificial Sequence
  Description of Artificial Sequence: Chemically synthesized oligonucleotide
cccccggatatcaaacttg

SEQ ID NO: 7055 - DNA, 19 bp, Artificial Sequence
  Description of Artificial Sequence: Chemically synthesized oligonucleotide
aagtttgatatccgggggc

SEQ ID NO: 7056 - DNA, 19 bp, Artificial Sequence
  Description of Artificial Sequence: Chemically synthesized oligonucleotide
gcccccggatatcaaactt

SEQ ID NO: 7057 - DNA, 19 bp, Artificial Sequence
  Description of Artificial Sequence: Chemically synthesized oligonucleotide
agtttgatatccgggggca

SEQ ID NO: 7058 - DNA, 19 bp, Artificial Sequence
  Description of Artificial Sequence: Chemically synthesized oligonucleotide
tgcccccggatatcaaact

SEQ ID NO: 7059 - DNA, 19 bp, Artificial Sequence
  Description of Artificial Sequence: Chemically synthesized oligonucleotide
gtttgatatccgggggcac

SEQ ID NO: 7060 - DNA, 19 bp, Artificial Sequence
  Description of Artificial Sequence: Chemically synthesized oligonucleotide
gtgcccccggatatcaaac

SEQ ID NO: 7061 - DNA, 19 bp, Artificial Sequence
  Description of Artificial Sequence: Chemically synthesized oligonucleotide
tttgatatccgggggcact

SEQ ID NO: 7062 - DNA, 19 bp, Artificial Sequence
  Description of Artificial Sequence: Chemically synthesized oligonucleotide
agtgcccccggatatcaaa

SEQ ID NO: 7063 - DNA, 19 bp, Artificial Sequence
  Description of Artificial Sequence: Chemically synthesized oligonucleotide
ttgatatccgggggcactg

SEQ ID NO: 7064 - DNA, 19 bp, Artificial Sequence
  Description of Artificial Sequence: Chemically synthesized oligonucleotide
cagtgcccccggatatcaa

SEQ ID NO: 7065 - DNA, 19 bp, Artificial Sequence
  Description of Artificial Sequence: Chemically synthesized oligonucleotide
tgatatccgggggcactgc

SEQ ID NO: 7066 - DNA, 19 bp, Artificial Sequence
  Description of Artificial Sequence: Chemically synthesized oligonucleotide
gcagtgcccccggatatca

SEQ ID NO: 7067 - DNA, 19 bp, Artificial Sequence
  Description of Artificial Sequence: Chemically synthesized oligonucleotide
gatatccgggggcactgcc

SEQ ID NO: 7068 - DNA, 19 bp, Artificial Sequence
  Description of Artificial Sequence: Chemically synthesized oligonucleotide
ggcagtgcccccggatatc

SEQ ID NO: 7069 - DNA, 19 bp, Artificial Sequence
  Description of Artificial Sequence: Chemically synthesized oligonucleotide
atatccgggggcactgccc

SEQ ID NO: 7070 - DNA, 19 bp, Artificial Sequence
  Description of Artificial Sequence: Chemically synthesized oligonucleotide
gggcagtgcccccggatat

SEQ ID NO: 7071 - DNA, 19 bp, Artificial Sequence
  Description of Artificial Sequence: Chemically synthesized oligonucleotide
tatccgggggcactgcccc

SEQ ID NO: 7072 - DNA, 19 bp, Artificial Sequence
  Description of Artificial Sequence: Chemically synthesized oligonucleotide
ggggcagtgcccccggata

SEQ ID NO: 7073 - DNA, 19 bp, Artificial Sequence
  Description of Artificial Sequence: Chemically synthesized oligonucleotide
atccgggggcactgcccct

SEQ ID NO: 7074 - DNA, 19 bp, Artificial Sequence
  Description of Artificial Sequence: Chemically synthesized oligonucleotide
aggggcagtgcccccggat

SEQ ID NO: 7075 - DNA, 19 bp, Artificial Sequence
  Description of Artificial Sequence: Chemically synthesized oligonucleotide
tccgggggcactgcccctg

SEQ ID NO: 7076 - DNA, 19 bp, Artificial Sequence
  Description of Artificial Sequence: Chemically synthesized oligonucleotide
caggggcagtgcccccgga

SEQ ID NO: 7077 - DNA, 19 bp, Artificial Sequence
  Description of Artificial Sequence: Chemically synthesized oligonucleotide
ccgggggcactgcccctgc

SEQ ID NO: 7078 - DNA, 19 bp, Artificial Sequence
  Description of Artificial Sequence: Chemically synthesized oligonucleotide
gcaggggcagtgcccccgg

SEQ ID NO: 7079 - DNA, 19 bp, Artificial Sequence
  Description of Artificial Sequence: Chemically synthesized oligonucleotide
cgggggcactgcccctgcc

SEQ ID NO: 7080 - DNA, 19 bp, Artificial Sequence
  Description of Artificial Sequence: Chemically synthesized oligonucleotide
ggcaggggcagtgcccccg

SEQ ID NO: 7081 - DNA, 19 bp, Artificial Sequence
  Description of Artificial Sequence: Chemically synthesized oligonucleotide
gggggcactgcccctgcca

SEQ ID NO: 7082 - DNA, 19 bp, Artificial Sequence
  Description of Artificial Sequence: Chemically synthesized oligonucleotide
tggcaggggcagtgccccc

SEQ ID NO: 7083 - DNA, 19 bp, Artificial Sequence
  Description of Artificial Sequence: Chemically synthesized oligonucleotide
ggggcactgcccctgccaa

SEQ ID NO: 7084 - DNA, 19 bp, Artificial Sequence
  Description of Artificial Sequence: Chemically synthesized oligonucleotide
ttggcaggggcagtgcccc

SEQ ID NO: 7085 - DNA, 19 bp, Artificial Sequence
  Description of Artificial Sequence: Chemically synthesized oligonucleotide
gggcactgcccctgccaag

SEQ ID NO: 7086 - DNA, 19 bp, Artificial Sequence
  Description of Artificial Sequence: Chemically synthesized oligonucleotide
cttggcaggggcagtgccc

SEQ ID NO: 7087 - DNA, 19 bp, Artificial Sequence
  Description of Artificial Sequence: Chemically synthesized oligonucleotide
ggcactgcccctgccaagc

SEQ ID NO: 7088 - DNA, 19 bp, Artificial Sequence
  Description of Artificial Sequence: Chemically synthesized oligonucleotide
gcttggcaggggcagtgcc

SEQ ID NO: 7089 - DNA, 19 bp, Artificial Sequence
  Description of Artificial Sequence: Chemically synthesized oligonucleotide
gcactgcccctgccaagct

SEQ ID NO: 7090 - DNA, 19 bp, Artificial Sequence
  Description of Artificial Sequence: Chemically synthesized oligonucleotide
agcttggcaggggcagtgc

SEQ ID NO: 7091 - DNA, 19 bp, Artificial Sequence
  Description of Artificial Sequence: Chemically synthesized oligonucleotide
cactgcccctgccaagctg

SEQ ID NO: 7092 - DNA, 19 bp, Artificial Sequence
  Description of Artificial Sequence: Chemically synthesized oligonucleotide
cagcttggcaggggcagtg

SEQ ID NO: 7093 - DNA, 19 bp, Artificial Sequence
  Description of Artificial Sequence: Chemically synthesized oligonucleotide
actgcccctgccaagctga

SEQ ID NO: 7094 - DNA, 19 bp, Artificial Sequence
  Description of Artificial Sequence: Chemically synthesized oligonucleotide
tcagcttggcaggggcagt

SEQ ID NO: 7095 - DNA, 19 bp, Artificial Sequence
  Description of Artificial Sequence: Chemically synthesized oligonucleotide
ctgcccctgccaagctgat

SEQ ID NO: 7096 - DNA, 19 bp, Artificial Sequence
  Description of Artificial Sequence: Chemically synthesized oligonucleotide
atcagcttggcaggggcag

SEQ ID NO: 7097 - DNA, 19 bp, Artificial Sequence
  Description of Artificial Sequence: Chemically synthesized oligonucleotide
tgcccctgccaagctgatg

SEQ ID NO: 7098 - DNA, 19 bp, Artificial Sequence
  Description of Artificial Sequence: Chemically synthesized oligonucleotide
catcagcttggcaggggca

SEQ ID NO: 7099 - DNA, 19 bp, Artificial Sequence
  Description of Artificial Sequence: Chemically synthesized oligonucleotide
gcccctgccaagctgatgc

SEQ ID NO: 7100 - DNA, 19 bp, Artificial Sequence
  Description of Artificial Sequence: Chemically synthesized oligonucleotide
gcatcagcttggcaggggc

SEQ ID NO: 7101 - DNA, 19 bp, Artificial Sequence
  Description of Artificial Sequence: Chemically synthesized oligonucleotide
cccctgccaagctgatgcc

SEQ ID NO: 7102 - DNA, 19 bp, Artificial Sequence
  Description of Artificial Sequence: Chemically synthesized oligonucleotide
ggcatcagcttggcagggg

SEQ ID NO: 7103 - DNA, 19 bp, Artificial Sequence
  Description of Artificial Sequence: Chemically synthesized oligonucleotide
ccctgccaagctgatgccc

SEQ ID NO: 7104 - DNA, 19 bp, Artificial Sequence
  Description of Artificial Sequence: Chemically synthesized oligonucleotide
gggcatcagcttggcaggg

SEQ ID NO: 7105 - DNA, 19 bp, Artificial Sequence
  Description of Artificial Sequence: Chemically synthesized oligonucleotide
cctgccaagctgatgcccg

SEQ ID NO: 7106 - DNA, 19 bp, Artificial Sequence
  Description of Artificial Sequence: Chemically synthesized oligonucleotide
cgggcatcagcttggcagg

SEQ ID NO: 7107 - DNA, 19 bp, Artificial Sequence
  Description of Artificial Sequence: Chemically synthesized oligonucleotide
ctgccaagctgatgcccgg

SEQ ID NO: 7108 - DNA, 19 bp, Artificial Sequence
  Description of Artificial Sequence: Chemically synthesized oligonucleotide
ccgggcatcagcttggcag

SEQ ID NO: 7109 - DNA, 19 bp, Artificial Sequence
  Description of Artificial Sequence: Chemically synthesized oligonucleotide
tgccaagctgatgcccggg

SEQ ID NO: 7110 - DNA, 19 bp, Artificial Sequence
  Description of Artificial Sequence: Chemically synthesized oligonucleotide
cccgggcatcagcttggca

SEQ ID NO: 7111 - DNA, 19 bp, Artificial Sequence
  Description of Artificial Sequence: Chemically synthesized oligonucleotide
gccaagctgatgcccgggt

SEQ ID NO: 7112 - DNA, 19 bp, Artificial Sequence
  Description of Artificial Sequence: Chemically synthesized oligonucleotide
acccgggcatcagcttggc

SEQ ID NO: 7113 - DNA, 19 bp, Artificial Sequence
  Description of Artificial Sequence: Chemically synthesized oligonucleotide
ccaagctgatgcccgggta

SEQ ID NO: 7114 - DNA, 19 bp, Artificial Sequence
  Description of Artificial Sequence: Chemically synthesized oligonucleotide
tacccgggcatcagcttgg

SEQ ID NO: 7115 - DNA, 19 bp, Artificial Sequence
  Description of Artificial Sequence: Chemically synthesized oligonucleotide
caagctgatgcccgggtat

SEQ ID NO: 7116 - DNA, 19 bp, Artificial Sequence
  Description of Artificial Sequence: Chemically synthesized oligonucleotide
atacccgggcatcagcttg

SEQ ID NO: 7117 - DNA, 19 bp, Artificial Sequence
  Description of Artificial Sequence: Chemically synthesized oligonucleotide
aagctgatgcccgggtatg

SEQ ID NO: 7118 - DNA, 19 bp, Artificial Sequence
  Description of Artificial Sequence: Chemically synthesized oligonucleotide
catacccgggcatcagctt

SEQ ID NO: 7119 - DNA, 19 bp, Artificial Sequence
  Description of Artificial Sequence: Chemically synthesized oligonucleotide
agctgatgcccgggtatgg

SEQ ID NO: 7120 - DNA, 19 bp, Artificial Sequence
  Description of Artificial Sequence: Chemically synthesized oligonucleotide
ccatacccgggcatcagct

SEQ ID NO: 7121 - DNA, 19 bp, Artificial Sequence
  Description of Artificial Sequence: Chemically synthesized oligonucleotide
gctgatgcccgggtatggg

SEQ ID NO: 7122 - DNA, 19 bp, Artificial Sequence
  Description of Artificial Sequence: Chemically synthesized oligonucleotide
cccatacccgggcatcagc

SEQ ID NO: 7123 - DNA, 19 bp, Artificial Sequence
  Description of Artificial Sequence: Chemically synthesized oligonucleotide
ctgatgcccgggtatgggc

SEQ ID NO: 7124 - DNA, 19 bp, Artificial Sequence
  Description of Artificial Sequence: Chemically synthesized oligonucleotide
gcccatacccgggcatcag

SEQ ID NO: 7125 - DNA, 19 bp, Artificial Sequence
  Description of Artificial Sequence: Chemically synthesized oligonucleotide
tgatgcccgggtatgggcc

SEQ ID NO: 7126 - DNA, 19 bp, Artificial Sequence
  Description of Artificial Sequence: Chemically synthesized oligonucleotide
ggcccatacccgggcatca

SEQ ID NO: 7127 - DNA, 19 bp, Artificial Sequence
  Description of Artificial Sequence: Chemically synthesized oligonucleotide
gatgcccgggtatgggccc

SEQ ID NO: 7128 - DNA, 19 bp, Artificial Sequence
  Description of Artificial Sequence: Chemically synthesized oligonucleotide
gggcccatacccgggcatc

SEQ ID NO: 7129 - DNA, 19 bp, Artificial Sequence
  Description of Artificial Sequence: Chemically synthesized oligonucleotide
atgcccgggtatgggcccc

SEQ ID NO: 7130 - DNA, 19 bp, Artificial Sequence
  Description of Artificial Sequence: Chemically synthesized oligonucleotide
ggggcccatacccgggcat

SEQ ID NO: 7131 - DNA, 19 bp, Artificial Sequence
  Description of Artificial Sequence: Chemically synthesized oligonucleotide
tgcccgggtatgggccccc

SEQ ID NO: 7132 - DNA, 19 bp, Artificial Sequence
  Description of Artificial Sequence: Chemically synthesized oligonucleotide
gggggcccatacccgggca

SEQ ID NO: 7133 - DNA, 19 bp, Artificial Sequence
  Description of Artificial Sequence: Chemically synthesized oligonucleotide
gcccgggtatgggcccccg

SEQ ID NO: 7134 - DNA, 19 bp, Artificial Sequence
  Description of Artificial Sequence: Chemically synthesized oligonucleotide
cgggggcccatacccgggc

SEQ ID NO: 7135 - DNA, 19 bp, Artificial Sequence
  Description of Artificial Sequence: Chemically synthesized oligonucleotide
cccgggtatgggcccccgg

SEQ ID NO: 7136 - DNA, 19 bp, Artificial Sequence
  Description of Artificial Sequence: Chemically synthesized oligonucleotide
ccgggggcccatacccggg

SEQ ID NO: 7137 - DNA, 19 bp, Artificial Sequence
  Description of Artificial Sequence: Chemically synthesized oligonucleotide
ccgggtatgggcccccggg

SEQ ID NO: 7138 - DNA, 19 bp, Artificial Sequence
  Description of Artificial Sequence: Chemically synthesized oligonucleotide
cccgggggcccatacccgg

SEQ ID NO: 7139 - DNA, 19 bp, Artificial Sequence
  Description of Artificial Sequence: Chemically synthesized oligonucleotide
cgggtatgggcccccgggg

SEQ ID NO: 7140 - DNA, 19 bp, Artificial Sequence
  Description of Artificial Sequence: Chemically synthesized oligonucleotide
ccccgggggcccatacccg

SEQ ID NO: 7141 - DNA, 19 bp, Artificial Sequence
  Description of Artificial Sequence: Chemically synthesized oligonucleotide
gggtatgggcccccgggga

SEQ ID NO: 7142 - DNA, 19 bp, Artificial Sequence
  Description of Artificial Sequence: Chemically synthesized oligonucleotide
tccccgggggcccataccc

SEQ ID NO: 7143 - DNA, 19 bp, Artificial Sequence
  Description of Artificial Sequence: Chemically synthesized oligonucleotide
ggtatgggcccccggggat

SEQ ID NO: 7144 - DNA, 19 bp, Artificial Sequence
  Description of Artificial Sequence: Chemically synthesized oligonucleotide
atccccgggggcccatacc

SEQ ID NO: 7145 - DNA, 19 bp, Artificial Sequence
  Description of Artificial Sequence: Chemically synthesized oligonucleotide
gtatgggcccccggggatg

SEQ ID NO: 7146 - DNA, 19 bp, Artificial Sequence
  Description of Artificial Sequence: Chemically synthesized oligonucleotide
catccccgggggcccatac

SEQ ID NO: 7147 - DNA, 19 bp, Artificial Sequence
  Description of Artificial Sequence: Chemically synthesized oligonucleotide
tatgggcccccggggatgc

SEQ ID NO: 7148 - DNA, 19 bp, Artificial Sequence
  Description of Artificial Sequence: Chemically synthesized oligonucleotide
gcatccccgggggcccata

SEQ ID NO: 7149 - DNA, 19 bp, Artificial Sequence
  Description of Artificial Sequence: Chemically synthesized oligonucleotide
atgggcccccggggatgca

SEQ ID NO: 7150 - DNA, 19 bp, Artificial Sequence
  Description of Artificial Sequence: Chemically synthesized oligonucleotide
tgcatccccgggggcccat

SEQ ID NO: 7151 - DNA, 19 bp, Artificial Sequence
  Description of Artificial Sequence: Chemically synthesized oligonucleotide
tgggcccccggggatgcag

SEQ ID NO: 7152 - DNA, 19 bp, Artificial Sequence
  Description of Artificial Sequence: Chemically synthesized oligonucleotide
ctgcatccccgggggccca

SEQ ID NO: 7153 - DNA, 19 bp, Artificial Sequence
  Description of Artificial Sequence: Chemically synthesized oligonucleotide
gggcccccggggatgcagg

SEQ ID NO: 7154 - DNA, 19 bp, Artificial Sequence
  Description of Artificial Sequence: Chemically synthesized oligonucleotide
cctgcatccccgggggccc

SEQ ID NO: 7155 - DNA, 19 bp, Artificial Sequence
  Description of Artificial Sequence: Chemically synthesized oligonucleotide
ggcccccggggatgcaggc

SEQ ID NO: 7156 - DNA, 19 bp, Artificial Sequence
  Description of Artificial Sequence: Chemically synthesized oligonucleotide
gcctgcatccccgggggcc

SEQ ID NO: 7157 - DNA, 19 bp, Artificial Sequence
  Description of Artificial Sequence: Chemically synthesized oligonucleotide
gcccccggggatgcaggcc

SEQ ID NO: 7158 - DNA, 19 bp, Artificial Sequence
  Description of Artificial Sequence: Chemically synthesized oligonucleotide
ggcctgcatccccgggggc

SEQ ID NO: 7159 - DNA, 19 bp, Artificial Sequence
  Description of Artificial Sequence: Chemically synthesized oligonucleotide
cccccggggatgcaggcca

SEQ ID NO: 7160 - DNA, 19 bp, Artificial Sequence
  Description of Artificial Sequence: Chemically synthesized oligonucleotide
tggcctgcatccccggggg

SEQ ID NO: 7161 - DNA, 19 bp, Artificial Sequence
  Description of Artificial Sequence: Chemically synthesized oligonucleotide
ccccggggatgcaggccag

SEQ ID NO: 7162 - DNA, 19 bp, Artificial Sequence
  Description of Artificial Sequence: Chemically synthesized oligonucleotide
ctggcctgcatccccgggg

SEQ ID NO: 7163 - DNA, 19 bp, Artificial Sequence
  Description of Artificial Sequence: Chemically synthesized oligonucleotide
cccggggatgcaggccagc

SEQ ID NO: 7164 - DNA, 19 bp, Artificial Sequence
  Description of Artificial Sequence: Chemically synthesized oligonucleotide
gctggcctgcatccccggg

SEQ ID NO: 7165 - DNA, 19 bp, Artificial Sequence
  Description of Artificial Sequence: Chemically synthesized oligonucleotide
ccggggatgcaggccagca

SEQ ID NO: 7166 - DNA, 19 bp, Artificial Sequence
  Description of Artificial Sequence: Chemically synthesized oligonucleotide
tgctggcctgcatccccgg

SEQ ID NO: 7167 - DNA, 19 bp, Artificial Sequence
  Description of Artificial Sequence: Chemically synthesized oligonucleotide
cggggatgcaggccagcag

SEQ ID NO: 7168 - DNA, 19 bp, Artificial Sequence
  Description of Artificial Sequence: Chemically synthesized oligonucleotide
ctgctggcctgcatccccg

SEQ ID NO: 7169 - DNA, 19 bp, Artificial Sequence
  Description of Artificial Sequence: Chemically synthesized oligonucleotide
ggggatgcaggccagcaga

SEQ ID NO: 7170 - DNA, 19 bp, Artificial Sequence
  Description of Artificial Sequence: Chemically synthesized oligonucleotide
tctgctggcctgcatcccc

SEQ ID NO: 7171 - DNA, 19 bp, Artificial Sequence
  Description of Artificial Sequence: Chemically synthesized oligonucleotide
gggatgcaggccagcagaa

SEQ ID NO: 7172 - DNA, 19 bp, Artificial Sequence
  Description of Artificial Sequence: Chemically synthesized oligonucleotide
ttctgctggcctgcatccc

SEQ ID NO: 7173 - DNA, 19 bp, Artificial Sequence
  Description of Artificial Sequence: Chemically synthesized oligonucleotide
ggatgcaggccagcagaag

SEQ ID NO: 7174 - DNA, 19 bp, Artificial Sequence
  Description of Artificial Sequence: Chemically synthesized oligonucleotide
cttctgctggcctgcatcc

SEQ ID NO: 7175 - DNA, 19 bp, Artificial Sequence
  Description of Artificial Sequence: Chemically synthesized oligonucleotide
gatgcaggccagcagaagg

SEQ ID NO: 7176 - DNA, 19 bp, Artificial Sequence
  Description of Artificial Sequence: Chemically synthesized oligonucleotide
ccttctgctggcctgcatc

SEQ ID NO: 7177 - DNA, 19 bp, Artificial Sequence
  Description of Artificial Sequence: Chemically synthesized oligonucleotide
atgcaggccagcagaagga

SEQ ID NO: 7178 - DNA, 19 bp, Artificial Sequence
  Description of Artificial Sequence: Chemically synthesized oligonucleotide
tccttctgctggcctgcat

SEQ ID NO: 7179 - DNA, 19 bp, Artificial Sequence
  Description of Artificial Sequence: Chemically synthesized oligonucleotide
tgcaggccagcagaaggaa

SEQ ID NO: 7180 - DNA, 19 bp, Artificial Sequence
  Description of Artificial Sequence: Chemically synthesized oligonucleotide
ttccttctgctggcctgca

SEQ ID NO: 7181 - DNA, 19 bp, Artificial Sequence
  Description of Artificial Sequence: Chemically synthesized oligonucleotide
gcaggccagcagaaggaat

SEQ ID NO: 7182 - DNA, 19 bp, Artificial Sequence
  Description of Artificial Sequence: Chemically synthesized oligonucleotide
attccttctgctggcctgc

SEQ ID NO: 7183 - DNA, 19 bp, Artificial Sequence
  Description of Artificial Sequence: Chemically synthesized oligonucleotide
caggccagcagaaggaatc

SEQ ID NO: 7184 - DNA, 19 bp, Artificial Sequence
  Description of Artificial Sequence: Chemically synthesized oligonucleotide
gattccttctgctggcctg

SEQ ID NO: 7185 - DNA, 19 bp, Artificial Sequence
  Description of Artificial Sequence: Chemically synthesized oligonucleotide
aggccagcagaaggaatca

SEQ ID NO: 7186 - DNA, 19 bp, Artificial Sequence
  Description of Artificial Sequence: Chemically synthesized oligonucleotide
tgattccttctgctggcct

SEQ ID NO: 7187 - DNA, 19 bp, Artificial Sequence
  Description of Artificial Sequence: Chemically synthesized oligonucleotide
ggccagcagaaggaatcaa

SEQ ID NO: 7188 - DNA, 19 bp, Artificial Sequence
  Description of Artificial Sequence: Chemically synthesized oligonucleotide
ttgattccttctgctggcc

SEQ ID NO: 7189 - DNA, 19 bp, Artificial Sequence
  Description of Artificial Sequence: Chemically synthesized oligonucleotide
gccagcagaaggaatcaac

SEQ ID NO: 7190 - DNA, 19 bp, Artificial Sequence
  Description of Artificial Sequence: Chemically synthesized oligonucleotide
gttgattccttctgctggc

SEQ ID NO: 7191 - DNA, 19 bp, Artificial Sequence
  Description of Artificial Sequence: Chemically synthesized oligonucleotide
ccagcagaaggaatcaaca

SEQ ID NO: 7192 - DNA, 19 bp, Artificial Sequence
  Description of Artificial Sequence: Chemically synthesized oligonucleotide
tgttgattccttctgctgg

SEQ ID NO: 7193 - DNA, 19 bp, Artificial Sequence
  Description of Artificial Sequence: Chemically synthesized oligonucleotide
cagcagaaggaatcaacac

SEQ ID NO: 7194 - DNA, 19 bp, Artificial Sequence
  Description of Artificial Sequence: Chemically synthesized oligonucleotide
gtgttgattccttctgctg

SEQ ID NO: 7195 - DNA, 19 bp, Artificial Sequence
  Description of Artificial Sequence: Chemically synthesized oligonucleotide
agcagaaggaatcaacaca

SEQ ID NO: 7196 - DNA, 19 bp, Artificial Sequence
  Description of Artificial Sequence: Chemically synthesized oligonucleotide
tgtgttgattccttctgct

SEQ ID NO: 7197 - DNA, 19 bp, Artificial Sequence
  Description of Artificial Sequence: Chemically synthesized oligonucleotide
gcagaaggaatcaacacag

SEQ ID NO: 7198 - DNA, 19 bp, Artificial Sequence
  Description of Artificial Sequence: Chemically synthesized oligonucleotide
ctgtgttgattccttctgc

SEQ ID NO: 7199 - DNA, 19 bp, Artificial Sequence
  Description of Artificial Sequence: Chemically synthesized oligonucleotide
cagaaggaatcaacacaga

SEQ ID NO: 7200 - DNA, 19 bp, Artificial Sequence
  Description of Artificial Sequence: Chemically synthesized oligonucleotide
tctgtgttgattccttctg

SEQ ID NO: 7201 - DNA, 19 bp, Artificial Sequence
  Description of Artificial Sequence: Chemically synthesized oligonucleotide
agaaggaatcaacacagaa

SEQ ID NO: 7202 - DNA, 19 bp, Artificial Sequence
  Description of Artificial Sequence: Chemically synthesized oligonucleotide
ttctgtgttgattccttct

SEQ ID NO: 7203 - DNA, 19 bp, Artificial Sequence
  Description of Artificial Sequence: Chemically synthesized oligonucleotide
gaaggaatcaacacagaaa

SEQ ID NO: 7204 - DNA, 19 bp, Artificial Sequence
  Description of Artificial Sequence: Chemically synthesized oligonucleotide
tttctgtgttgattccttc

SEQ ID NO: 7205 - DNA, 19 bp, Artificial Sequence
  Description of Artificial Sequence: Chemically synthesized oligonucleotide
aaggaatcaacacagaaaa

SEQ ID NO: 7206 - DNA, 19 bp, Artificial Sequence
  Description of Artificial Sequence: Chemically synthesized oligonucleotide
ttttctgtgttgattcctt

SEQ ID NO: 7207 - DNA, 19 bp, Artificial Sequence
  Description of Artificial Sequence: Chemically synthesized oligonucleotide
aggaatcaacacagaaaac

SEQ ID NO: 7208 - DNA, 19 bp, Artificial Sequence
  Description of Artificial Sequence: Chemically synthesized oligonucleotide
gttttctgtgttgattcct

SEQ ID NO: 7209 - DNA, 19 bp, Artificial Sequence
  Description of Artificial Sequence: Chemically synthesized oligonucleotide
ggaatcaacacagaaaacg

SEQ ID NO: 7210 - DNA, 19 bp, Artificial Sequence
  Description of Artificial Sequence: Chemically synthesized oligonucleotide
cgttttctgtgttgattcc

SEQ ID NO: 7211 - DNA, 19 bp, Artificial Sequence
  Description of Artificial Sequence: Chemically synthesized oligonucleotide
gaatcaacacagaaaacgc

SEQ ID NO: 7212 - DNA, 19 bp, Artificial Sequence
  Description of Artificial Sequence: Chemically synthesized oligonucleotide
gcgttttctgtgttgattc

SEQ ID NO: 7213 - DNA, 19 bp, Artificial Sequence
  Description of Artificial Sequence: Chemically synthesized oligonucleotide
aatcaacacagaaaacgcc

SEQ ID NO: 7214 - DNA, 19 bp, Artificial Sequence
  Description of Artificial Sequence: Chemically synthesized oligonucleotide
ggcgttttctgtgttgatt

SEQ ID NO: 7215 - DNA, 19 bp, Artificial Sequence
  Description of Artificial Sequence: Chemically synthesized oligonucleotide
atcaacacagaaaacgccc

SEQ ID NO: 7216 - DNA, 19 bp, Artificial Sequence
  Description of Artificial Sequence: Chemically synthesized oligonucleotide
gggcgttttctgtgttgat

SEQ ID NO: 7217 - DNA, 19 bp, Artificial Sequence
  Description of Artificial Sequence: Chemically synthesized oligonucleotide
tcaacacagaaaacgcccc

SEQ ID NO: 7218 - DNA, 19 bp, Artificial Sequence
  Description of Artificial Sequence: Chemically synthesized oligonucleotide
ggggcgttttctgtgttga

SEQ ID NO: 7219 - DNA, 19 bp, Artificial Sequence
  Description of Artificial Sequence: Chemically synthesized oligonucleotide
caacacagaaaacgccccc

SEQ ID NO: 7220 - DNA, 19 bp, Artificial Sequence
  Description of Artificial Sequence: Chemically synthesized oligonucleotide
gggggcgttttctgtgttg

SEQ ID NO: 7221 - DNA, 19 bp, Artificial Sequence
  Description of Artificial Sequence: Chemically synthesized oligonucleotide
aacacagaaaacgccccca

SEQ ID NO: 7222 - DNA, 19 bp, Artificial Sequence
  Description of Artificial Sequence: Chemically synthesized oligonucleotide
tgggggcgttttctgtgtt

SEQ ID NO: 7223 - DNA, 19 bp, Artificial Sequence
  Description of Artificial Sequence: Chemically synthesized oligonucleotide
acacagaaaacgcccccaa

SEQ ID NO: 7224 - DNA, 19 bp, Artificial Sequence
  Description of Artificial Sequence: Chemically synthesized oligonucleotide
ttgggggcgttttctgtgt

SEQ ID NO: 7225 - DNA, 19 bp, Artificial Sequence
  Description of Artificial Sequence: Chemically synthesized oligonucleotide
cacagaaaacgcccccaac

SEQ ID NO: 7226 - DNA, 19 bp, Artificial Sequence
  Description of Artificial Sequence: Chemically synthesized oligonucleotide
gttgggggcgttttctgtg

SEQ ID NO: 7227 - DNA, 19 bp, Artificial Sequence
  Description of Artificial Sequence: Chemically synthesized oligonucleotide
acagaaaacgcccccaact

SEQ ID NO: 7228 - DNA, 19 bp, Artificial Sequence
  Description of Artificial Sequence: Chemically synthesized oligonucleotide
agttgggggcgttttctgt

SEQ ID NO: 7229 - DNA, 19 bp, Artificial Sequence
  Description of Artificial Sequence: Chemically synthesized oligonucleotide
cagaaaacgcccccaactc

SEQ ID NO: 7230 - DNA, 19 bp, Artificial Sequence
  Description of Artificial Sequence: Chemically synthesized oligonucleotide
gagttgggggcgttttctg

SEQ ID NO: 7231 - DNA, 19 bp, Artificial Sequence
  Description of Artificial Sequence: Chemically synthesized oligonucleotide
agaaaacgcccccaactcc

SEQ ID NO: 7232 - DNA, 19 bp, Artificial Sequence
  Description of Artificial Sequence: Chemically synthesized oligonucleotide
ggagttgggggcgttttct

SEQ ID NO: 7233 - DNA, 19 bp, Artificial Sequence
  Description of Artificial Sequence: Chemically synthesized oligonucleotide
gaaaacgcccccaactcca

SEQ ID NO: 7234 - DNA, 19 bp, Artificial Sequence
  Description of Artificial Sequence: Chemically synthesized oligonucleotide
tggagttgggggcgttttc

SEQ ID NO: 7235 - DNA, 19 bp, Artificial Sequence
  Description of Artificial Sequence: Chemically synthesized oligonucleotide
aaaacgcccccaactccac

SEQ ID NO: 7236 - DNA, 19 bp, Artificial Sequence
  Description of Artificial Sequence: Chemically synthesized oligonucleotide
gtggagttgggggcgtttt

SEQ ID NO: 7237 - DNA, 19 bp, Artificial Sequence
  Description of Artificial Sequence: Chemically synthesized oligonucleotide
aaacgcccccaactccaca

SEQ ID NO: 7238 - DNA, 19 bp, Artificial Sequence
  Description of Artificial Sequence: Chemically synthesized oligonucleotide
tgtggagttgggggcgttt

SEQ ID NO: 7239 - DNA, 19 bp, Artificial Sequence
  Description of Artificial Sequence: Chemically synthesized oligonucleotide
aacgcccccaactccacaa

SEQ ID NO: 7240 - DNA, 19 bp, Artificial Sequence
  Description of Artificial Sequence: Chemically synthesized oligonucleotide
ttgtggagttgggggcgtt

SEQ ID NO: 7241 - DNA, 19 bp, Artificial Sequence
  Description of Artificial Sequence: Chemically synthesized oligonucleotide
acgcccccaactccacaac

SEQ ID NO: 7242 - DNA, 19 bp, Artificial Sequence
  Description of Artificial Sequence: Chemically synthesized oligonucleotide
gttgtggagttgggggcgt

SEQ ID NO: 7243 - DNA, 19 bp, Artificial Sequence
  Description of Artificial Sequence: Chemically synthesized oligonucleotide
cgcccccaactccacaacc

SEQ ID NO: 7244 - DNA, 19 bp, Artificial Sequence
  Description of Artificial Sequence: Chemically synthesized oligonucleotide
ggttgtggagttgggggcg

SEQ ID NO: 7245 - DNA, 19 bp, Artificial Sequence
  Description of Artificial Sequence: Chemically synthesized oligonucleotide
gcccccaactccacaacct

SEQ ID NO: 7246 - DNA, 19 bp, Artificial Sequence
  Description of Artificial Sequence: Chemically synthesized oligonucleotide
aggttgtggagttgggggc

SEQ ID NO: 7247 - DNA, 19 bp, Artificial Sequence
  Description of Artificial Sequence: Chemically synthesized oligonucleotide
cccccaactccacaacctt

SEQ ID NO: 7248 - DNA, 19 bp, Artificial Sequence
  Description of Artificial Sequence: Chemically synthesized oligonucleotide
aaggttgtggagttggggg

SEQ ID NO: 7249 - DNA, 19 bp, Artificial Sequence
  Description of Artificial Sequence: Chemically synthesized oligonucleotide
ccccaactccacaaccttc

SEQ ID NO: 7250 - DNA, 19 bp, Artificial Sequence
  Description of Artificial Sequence: Chemically synthesized oligonucleotide
gaaggttgtggagttgggg

SEQ ID NO: 7251 - DNA, 19 bp, Artificial Sequence
  Description of Artificial Sequence: Chemically synthesized oligonucleotide
cccaactccacaaccttcc

SEQ ID NO: 7252 - DNA, 19 bp, Artificial Sequence
  Description of Artificial Sequence: Chemically synthesized oligonucleotide
ggaaggttgtggagttggg

SEQ ID NO: 7253 - DNA, 19 bp, Artificial Sequence
  Description of Artificial Sequence: Chemically synthesized oligonucleotide
ccaactccacaaccttcct

SEQ ID NO: 7254 - DNA, 19 bp, Artificial Sequence
  Description of Artificial Sequence: Chemically synthesized oligonucleotide
aggaaggttgtggagttgg

SEQ ID NO: 7255 - DNA, 19 bp, Artificial Sequence
  Description of Artificial Sequence: Chemically synthesized oligonucleotide
caactccacaaccttcctg

SEQ ID NO: 7256 - DNA, 19 bp, Artificial Sequence
  Description of Artificial Sequence: Chemically synthesized oligonucleotide
caggaaggttgtggagttg

SEQ ID NO: 7257 - DNA, 19 bp, Artificial Sequence
  Description of Artificial Sequence: Chemically synthesized oligonucleotide
aactccacaaccttcctgc

SEQ ID NO: 7258 - DNA, 19 bp, Artificial Sequence
  Description of Artificial Sequence: Chemically synthesized oligonucleotide
gcaggaaggttgtggagtt

SEQ ID NO: 7259 - DNA, 19 bp, Artificial Sequence
  Description of Artificial Sequence: Chemically synthesized oligonucleotide
actccacaaccttcctgca

SEQ ID NO: 7260 - DNA, 19 bp, Artificial Sequence
  Description of Artificial Sequence: Chemically synthesized oligonucleotide
tgcaggaaggttgtggagt

SEQ ID NO: 7261 - DNA, 19 bp, Artificial Sequence
  Description of Artificial Sequence: Chemically synthesized oligonucleotide
ctccacaaccttcctgcaa

SEQ ID NO: 7262 - DNA, 19 bp, Artificial Sequence
  Description of Artificial Sequence: Chemically synthesized oligonucleotide
ttgcaggaaggttgtggag

SEQ ID NO: 7263 - DNA, 19 bp, Artificial Sequence
  Description of Artificial Sequence: Chemically synthesized oligonucleotide
tccacaaccttcctgcaat

SEQ ID NO: 7264 - DNA, 19 bp, Artificial Sequence
  Description of Artificial Sequence: Chemically synthesized oligonucleotide
attgcaggaaggttgtgga

SEQ ID NO: 7265 - DNA, 19 bp, Artificial Sequence
  Description of Artificial Sequence: Chemically synthesized oligonucleotide
ccacaaccttcctgcaatg

SEQ ID NO: 7266 - DNA, 19 bp, Artificial Sequence
  Description of Artificial Sequence: Chemically synthesized oligonucleotide
cattgcaggaaggttgtgg

SEQ ID NO: 7267 - DNA, 19 bp, Artificial Sequence
  Description of Artificial Sequence: Chemically synthesized oligonucleotide
cacaaccttcctgcaatgg

SEQ ID NO: 7268 - DNA, 19 bp, Artificial Sequence
  Description of Artificial Sequence: Chemically synthesized oligonucleotide
ccattgcaggaaggttgtg

SEQ ID NO: 7269 - DNA, 19 bp, Artificial Sequence
  Description of Artificial Sequence: Chemically synthesized oligonucleotide
acaaccttcctgcaatggc

SEQ ID NO: 7270 - DNA, 19 bp, Artificial Sequence
  Description of Artificial Sequence: Chemically synthesized oligonucleotide
gccattgcaggaaggttgt

SEQ ID NO: 7271 - DNA, 19 bp, Artificial Sequence
  Description of Artificial Sequence: Chemically synthesized oligonucleotide
caaccttcctgcaatggcg

SEQ ID NO: 7272 - DNA, 19 bp, Artificial Sequence
  Description of Artificial Sequence: Chemically synthesized oligonucleotide
cgccattgcaggaaggttg

SEQ ID NO: 7273 - DNA, 19 bp, Artificial Sequence
  Description of Artificial Sequence: Chemically synthesized oligonucleotide
aaccttcctgcaatggcga

SEQ ID NO: 7274 - DNA, 19 bp, Artificial Sequence
  Description of Artificial Sequence: Chemically synthesized oligonucleotide
tcgccattgcaggaaggtt

SEQ ID NO: 7275 - DNA, 19 bp, Artificial Sequence
  Description of Artificial Sequence: Chemically synthesized oligonucleotide
accttcctgcaatggcgac

SEQ ID NO: 7276 - DNA, 19 bp, Artificial Sequence
  Description of Artificial Sequence: Chemically synthesized oligonucleotide
gtcgccattgcaggaaggt

SEQ ID NO: 7277 - DNA, 19 bp, Artificial Sequence
  Description of Artificial Sequence: Chemically synthesized oligonucleotide
ccttcctgcaatggcgaca

SEQ ID NO: 7278 - DNA, 19 bp, Artificial Sequence
  Description of Artificial Sequence: Chemically synthesized oligonucleotide
tgtcgccattgcaggaagg

SEQ ID NO: 7279 - DNA, 19 bp, Artificial Sequence
  Description of Artificial Sequence: Chemically synthesized oligonucleotide
cttcctgcaatggcgacac

SEQ ID NO: 7280 - DNA, 19 bp, Artificial Sequence
  Description of Artificial Sequence: Chemically synthesized oligonucleotide
gtgtcgccattgcaggaag

SEQ ID NO: 7281 - DNA, 19 bp, Artificial Sequence
  Description of Artificial Sequence: Chemically synthesized oligonucleotide
ttcctgcaatggcgacacc

SEQ ID NO: 7282 - DNA, 19 bp, Artificial Sequence
  Description of Artificial Sequence: Chemically synthesized oligonucleotide
ggtgtcgccattgcaggaa

SEQ ID NO: 7283 - DNA, 19 bp, Artificial Sequence
  Description of Artificial Sequence: Chemically synthesized oligonucleotide
tcctgcaatggcgacaccc

SEQ ID NO: 7284 - DNA, 19 bp, Artificial Sequence
  Description of Artificial Sequence: Chemically synthesized oligonucleotide
gggtgtcgccattgcagga

SEQ ID NO: 7285 - DNA, 19 bp, Artificial Sequence
  Description of Artificial Sequence: Chemically synthesized oligonucleotide
cctgcaatggcgacaccca

SEQ ID NO: 7286 - DNA, 19 bp, Artificial Sequence
  Description of Artificial Sequence: Chemically synthesized oligonucleotide
tgggtgtcgccattgcagg

SEQ ID NO: 7287 - DNA, 19 bp, Artificial Sequence
  Description of Artificial Sequence: Chemically synthesized oligonucleotide
ctgcaatggcgacacccac

SEQ ID NO: 7288 - DNA, 19 bp, Artificial Sequence
  Description of Artificial Sequence: Chemically synthesized oligonucleotide
gtgggtgtcgccattgcag

SEQ ID NO: 7289 - DNA, 19 bp, Artificial Sequence
  Description of Artificial Sequence: Chemically synthesized oligonucleotide
tgcaatggcgacacccaca

SEQ ID NO: 7290 - DNA, 19 bp, Artificial Sequence
  Description of Artificial Sequence: Chemically synthesized oligonucleotide
tgtgggtgtcgccattgca

SEQ ID NO: 7291 - DNA, 19 bp, Artificial Sequence
  Description of Artificial Sequence: Chemically synthesized oligonucleotide
gcaatggcgacacccacag

SEQ ID NO: 7292 - DNA, 19 bp, Artificial Sequence
  Description of Artificial Sequence: Chemically synthesized oligonucleotide
ctgtgggtgtcgccattgc

SEQ ID NO: 7293 - DNA, 19 bp, Artificial Sequence
  Description of Artificial Sequence: Chemically synthesized oligonucleotide
caatggcgacacccacagg

SEQ ID NO: 7294 - DNA, 19 bp, Artificial Sequence
  Description of Artificial Sequence: Chemically synthesized oligonucleotide
cctgtgggtgtcgccattg

SEQ ID NO: 7295 - DNA, 19 bp, Artificial Sequence
  Description of Artificial Sequence: Chemically synthesized oligonucleotide
aatggcgacacccacagga

SEQ ID NO: 7296 - DNA, 19 bp, Artificial Sequence
  Description of Artificial Sequence: Chemically synthesized oligonucleotide
tcctgtgggtgtcgccatt

SEQ ID NO: 7297 - DNA, 19 bp, Artificial Sequence
  Description of Artificial Sequence: Chemically synthesized oligonucleotide
atggcgacacccacaggac

SEQ ID NO: 7298 - DNA, 19 bp, Artificial Sequence
  Description of Artificial Sequence: Chemically synthesized oligonucleotide
gtcctgtgggtgtcgccat

SEQ ID NO: 7299 - DNA, 19 bp, Artificial Sequence
  Description of Artificial Sequence: Chemically synthesized oligonucleotide
tggcgacacccacaggacc

SEQ ID NO: 7300 - DNA, 19 bp, Artificial Sequence
  Description of Artificial Sequence: Chemically synthesized oligonucleotide
ggtcctgtgggtgtcgcca

SEQ ID NO: 7301 - DNA, 19 bp, Artificial Sequence
  Description of Artificial Sequence: Chemically synthesized oligonucleotide
ggcgacacccacaggacca

SEQ ID NO: 7302 - DNA, 19 bp, Artificial Sequence
  Description of Artificial Sequence: Chemically synthesized oligonucleotide
tggtcctgtgggtgtcgcc

SEQ ID NO: 7303 - DNA, 19 bp, Artificial Sequence
  Description of Artificial Sequence: Chemically synthesized oligonucleotide
gcgacacccacaggaccaa

SEQ ID NO: 7304 - DNA, 19 bp, Artificial Sequence
  Description of Artificial Sequence: Chemically synthesized oligonucleotide
ttggtcctgtgggtgtcgc

SEQ ID NO: 7305 - DNA, 19 bp, Artificial Sequence
  Description of Artificial Sequence: Chemically synthesized oligonucleotide
cgacacccacaggaccaag

SEQ ID NO: 7306 - DNA, 19 bp, Artificial Sequence
  Description of Artificial Sequence: Chemically synthesized oligonucleotide
cttggtcctgtgggtgtcg

SEQ ID NO: 7307 - DNA, 19 bp, Artificial Sequence
  Description of Artificial Sequence: Chemically synthesized oligonucleotide
gacacccacaggaccaaga

SEQ ID NO: 7308 - DNA, 19 bp, Artificial Sequence
  Description of Artificial Sequence: Chemically synthesized oligonucleotide
tcttggtcctgtgggtgtc

SEQ ID NO: 7309 - DNA, 19 bp, Artificial Sequence
  Description of Artificial Sequence: Chemically synthesized oligonucleotide
acacccacaggaccaagag

SEQ ID NO: 7310 - DNA, 19 bp, Artificial Sequence
  Description of Artificial Sequence: Chemically synthesized oligonucleotide
ctcttggtcctgtgggtgt

SEQ ID NO: 7311 - DNA, 19 bp, Artificial Sequence
  Description of Artificial Sequence: Chemically synthesized oligonucleotide
cacccacaggaccaagagc

SEQ ID NO: 7312 - DNA, 19 bp, Artificial Sequence
  Description of Artificial Sequence: Chemically synthesized oligonucleotide
gctcttggtcctgtgggtg

SEQ ID NO: 7313 - DNA, 19 bp, Artificial Sequence
  Description of Artificial Sequence: Chemically synthesized oligonucleotide
acccacaggaccaagagca

SEQ ID NO: 7314 - DNA, 19 bp, Artificial Sequence
  Description of Artificial Sequence: Chemically synthesized oligonucleotide
tgctcttggtcctgtgggt

SEQ ID NO: 7315 - DNA, 19 bp, Artificial Sequence
  Description of Artificial Sequence: Chemically synthesized oligonucleotide
cccacaggaccaagagcat

SEQ ID NO: 7316 - DNA, 19 bp, Artificial Sequence
  Description of Artificial Sequence: Chemically synthesized oligonucleotide
atgctcttggtcctgtggg

SEQ ID NO: 7317 - DNA, 19 bp, Artificial Sequence
  Description of Artificial Sequence: Chemically synthesized oligonucleotide
ccacaggaccaagagcatc

SEQ ID NO: 7318 - DNA, 19 bp, Artificial Sequence
  Description of Artificial Sequence: Chemically synthesized oligonucleotide
gatgctcttggtcctgtgg

SEQ ID NO: 7319 - DNA, 19 bp, Artificial Sequence
  Description of Artificial Sequence: Chemically synthesized oligonucleotide
cacaggaccaagagcatca

SEQ ID NO: 7320 - DNA, 19 bp, Artificial Sequence
  Description of Artificial Sequence: Chemically synthesized oligonucleotide
tgatgctcttggtcctgtg

SEQ ID NO: 7321 - DNA, 19 bp, Artificial Sequence
  Description of Artificial Sequence: Chemically synthesized oligonucleotide
acaggaccaagagcatcaa

SEQ ID NO: 7322 - DNA, 19 bp, Artificial Sequence
  Description of Artificial Sequence: Chemically synthesized oligonucleotide
ttgatgctcttggtcctgt

SEQ ID NO: 7323 - DNA, 19 bp, Artificial Sequence
  Description of Artificial Sequence: Chemically synthesized oligonucleotide
caggaccaagagcatcaaa

SEQ ID NO: 7324 - DNA, 19 bp, Artificial Sequence
  Description of Artificial Sequence: Chemically synthesized oligonucleotide
tttgatgctcttggtcctg

SEQ ID NO: 7325 - DNA, 19 bp, Artificial Sequence
  Description of Artificial Sequence: Chemically synthesized oligonucleotide
aggaccaagagcatcaaag

SEQ ID NO: 7326 - DNA, 19 bp, Artificial Sequence
  Description of Artificial Sequence: Chemically synthesized oligonucleotide
ctttgatgctcttggtcct

SEQ ID NO: 7327 - DNA, 19 bp, Artificial Sequence
  Description of Artificial Sequence: Chemically synthesized oligonucleotide
ggaccaagagcatcaaaga

SEQ ID NO: 7328 - DNA, 19 bp, Artificial Sequence
  Description of Artificial Sequence: Chemically synthesized oligonucleotide
tctttgatgctcttggtcc

SEQ ID NO: 7329 - DNA, 19 bp, Artificial Sequence
  Description of Artificial Sequence: Chemically synthesized oligonucleotide
gaccaagagcatcaaagag

SEQ ID NO: 7330 - DNA, 19 bp, Artificial Sequence
  Description of Artificial Sequence: Chemically synthesized oligonucleotide
ctctttgatgctcttggtc

SEQ ID NO: 7331 - DNA, 19 bp, Artificial Sequence
  Description of Artificial Sequence: Chemically synthesized oligonucleotide
accaagagcatcaaagagg

SEQ ID NO: 7332 - DNA, 19 bp, Artificial Sequence
  Description of Artificial Sequence: Chemically synthesized oligonucleotide
cctctttgatgctcttggt

SEQ ID NO: 7333 - DNA, 19 bp, Artificial Sequence
  Description of Artificial Sequence: Chemically synthesized oligonucleotide
ccaagagcatcaaagagga

SEQ ID NO: 7334 - DNA, 19 bp, Artificial Sequence
  Description of Artificial Sequence: Chemically synthesized oligonucleotide
tcctctttgatgctcttgg

SEQ ID NO: 7335 - DNA, 19 bp, Artificial Sequence
  Description of Artificial Sequence: Chemically synthesized oligonucleotide
caagagcatcaaagaggag

SEQ ID NO: 7336 - DNA, 19 bp, Artificial Sequence
  Description of Artificial Sequence: Chemically synthesized oligonucleotide
ctcctctttgatgctcttg

SEQ ID NO: 7337 - DNA, 19 bp, Artificial Sequence
  Description of Artificial Sequence: Chemically synthesized oligonucleotide
aagagcatcaaagaggaga

SEQ ID NO: 7338 - DNA, 19 bp, Artificial Sequence
  Description of Artificial Sequence: Chemically synthesized oligonucleotide
tctcctctttgatgctctt

SEQ ID NO: 7339 - DNA, 19 bp, Artificial Sequence
  Description of Artificial Sequence: Chemically synthesized oligonucleotide
agagcatcaaagaggagac

SEQ ID NO: 7340 - DNA, 19 bp, Artificial Sequence
  Description of Artificial Sequence: Chemically synthesized oligonucleotide
gtctcctctttgatgctct

SEQ ID NO: 7341 - DNA, 19 bp, Artificial Sequence
  Description of Artificial Sequence: Chemically synthesized oligonucleotide
gagcatcaaagaggagacc

SEQ ID NO: 7342 - DNA, 19 bp, Artificial Sequence
  Description of Artificial Sequence: Chemically synthesized oligonucleotide
ggtctcctctttgatgctc

SEQ ID NO: 7343 - DNA, 19 bp, Artificial Sequence
  Description of Artificial Sequence: Chemically synthesized oligonucleotide
agcatcaaagaggagaccc

SEQ ID NO: 7344 - DNA, 19 bp, Artificial Sequence
  Description of Artificial Sequence: Chemically synthesized oligonucleotide
gggtctcctctttgatgct

SEQ ID NO: 7345 - DNA, 19 bp, Artificial Sequence
  Description of Artificial Sequence: Chemically synthesized oligonucleotide
gcatcaaagaggagacccc

SEQ ID NO: 7346 - DNA, 19 bp, Artificial Sequence
  Description of Artificial Sequence: Chemically synthesized oligonucleotide
ggggtctcctctttgatgc

SEQ ID NO: 7347 - DNA, 19 bp, Artificial Sequence
  Description of Artificial Sequence: Chemically synthesized oligonucleotide
catcaaagaggagaccccc

SEQ ID NO: 7348 - DNA, 19 bp, Artificial Sequence
  Description of Artificial Sequence: Chemically synthesized oligonucleotide
gggggtctcctctttgatg

SEQ ID NO: 7349 - DNA, 19 bp, Artificial Sequence
  Description of Artificial Sequence: Chemically synthesized oligonucleotide
atcaaagaggagacccccg

SEQ ID NO: 7350 - DNA, 19 bp, Artificial Sequence
  Description of Artificial Sequence: Chemically synthesized oligonucleotide
cgggggtctcctctttgat

SEQ ID NO: 7351 - DNA, 19 bp, Artificial Sequence
  Description of Artificial Sequence: Chemically synthesized oligonucleotide
tcaaagaggagacccccga

SEQ ID NO: 7352 - DNA, 19 bp, Artificial Sequence
  Description of Artificial Sequence: Chemically synthesized oligonucleotide
tcgggggtctcctctttga

SEQ ID NO: 7353 - DNA, 19 bp, Artificial Sequence
  Description of Artificial Sequence: Chemically synthesized oligonucleotide
caaagaggagacccccgat

SEQ ID NO: 7354 - DNA, 19 bp, Artificial Sequence
  Description of Artificial Sequence: Chemically synthesized oligonucleotide
atcgggggtctcctctttg

SEQ ID NO: 7355 - DNA, 19 bp, Artificial Sequence
  Description of Artificial Sequence: Chemically synthesized oligonucleotide
aaagaggagacccccgatt

SEQ ID NO: 7356 - DNA, 19 bp, Artificial Sequence
  Description of Artificial Sequence: Chemically synthesized oligonucleotide
aatcgggggtctcctcttt

SEQ ID NO: 7357 - DNA, 19 bp, Artificial Sequence
  Description of Artificial Sequence: Chemically synthesized oligonucleotide
aagaggagacccccgattc

SEQ ID NO: 7358 - DNA, 19 bp, Artificial Sequence
  Description of Artificial Sequence: Chemically synthesized oligonucleotide
gaatcgggggtctcctctt

SEQ ID NO: 7359 - DNA, 19 bp, Artificial Sequence
  Description of Artificial Sequence: Chemically synthesized oligonucleotide
agaggagacccccgattcc

SEQ ID NO: 7360 - DNA, 19 bp, Artificial Sequence
  Description of Artificial Sequence: Chemically synthesized oligonucleotide
ggaatcgggggtctcctct

SEQ ID NO: 7361 - DNA, 19 bp, Artificial Sequence
  Description of Artificial Sequence: Chemically synthesized oligonucleotide
gaggagacccccgattccg

SEQ ID NO: 7362 - DNA, 19 bp, Artificial Sequence
  Description of Artificial Sequence: Chemically synthesized oligonucleotide
cggaatcgggggtctcctc

SEQ ID NO: 7363 - DNA, 19 bp, Artificial Sequence
  Description of Artificial Sequence: Chemically synthesized oligonucleotide
aggagacccccgattccgc

SEQ ID NO: 7364 - DNA, 19 bp, Artificial Sequence
  Description of Artificial Sequence: Chemically synthesized oligonucleotide
gcggaatcgggggtctcct

SEQ ID NO: 7365 - DNA, 19 bp, Artificial Sequence
  Description of Artificial Sequence: Chemically synthesized oligonucleotide
ggagacccccgattccgct

SEQ ID NO: 7366 - DNA, 19 bp, Artificial Sequence
  Description of Artificial Sequence: Chemically synthesized oligonucleotide
agcggaatcgggggtctcc

SEQ ID NO: 7367 - DNA, 19 bp, Artificial Sequence
  Description of Artificial Sequence: Chemically synthesized oligonucleotide
gagacccccgattccgctg

SEQ ID NO: 7368 - DNA, 19 bp, Artificial Sequence
  Description of Artificial Sequence: Chemically synthesized oligonucleotide
cagcggaatcgggggtctc

SEQ ID NO: 7369 - DNA, 19 bp, Artificial Sequence
  Description of Artificial Sequence: Chemically synthesized oligonucleotide
agacccccgattccgctga

SEQ ID NO: 7370 - DNA, 19 bp, Artificial Sequence
  Description of Artificial Sequence: Chemically synthesized oligonucleotide
tcagcggaatcgggggtct

SEQ ID NO: 7371 - DNA, 19 bp, Artificial Sequence
  Description of Artificial Sequence: Chemically synthesized oligonucleotide
gacccccgattccgctgag

SEQ ID NO: 7372 - DNA, 19 bp, Artificial Sequence
  Description of Artificial Sequence: Chemically synthesized oligonucleotide
ctcagcggaatcgggggtc

SEQ ID NO: 7373 - DNA, 19 bp, Artificial Sequence
  Description of Artificial Sequence: Chemically synthesized oligonucleotide
acccccgattccgctgaga

SEQ ID NO: 7374 - DNA, 19 bp, Artificial Sequence
  Description of Artificial Sequence: Chemically synthesized oligonucleotide
tctcagcggaatcgggggt

SEQ ID NO: 7375 - DNA, 19 bp, Artificial Sequence
  Description of Artificial Sequence: Chemically synthesized oligonucleotide
cccccgattccgctgagac

SEQ ID NO: 7376 - DNA, 19 bp, Artificial Sequence
  Description of Artificial Sequence: Chemically synthesized oligonucleotide
gtctcagcggaatcggggg

SEQ ID NO: 7377 - DNA, 19 bp, Artificial Sequence
  Description of Artificial Sequence: Chemically synthesized oligonucleotide
ccccgattccgctgagacc

SEQ ID NO: 7378 - DNA, 19 bp, Artificial Sequence
  Description of Artificial Sequence: Chemically synthesized oligonucleotide
ggtctcagcggaatcgggg

SEQ ID NO: 7379 - DNA, 19 bp, Artificial Sequence
  Description of Artificial Sequence: Chemically synthesized oligonucleotide
cccgattccgctgagaccc

SEQ ID NO: 7380 - DNA, 19 bp, Artificial Sequence
  Description of Artificial Sequence: Chemically synthesized oligonucleotide
gggtctcagcggaatcggg

SEQ ID NO: 7381 - DNA, 19 bp, Artificial Sequence
  Description of Artificial Sequence: Chemically synthesized oligonucleotide
ccgattccgctgagacccc

SEQ ID NO: 7382 - DNA, 19 bp, Artificial Sequence
  Description of Artificial Sequence: Chemically synthesized oligonucleotide
ggggtctcagcggaatcgg

SEQ ID NO: 7383 - DNA, 19 bp, Artificial Sequence
  Description of Artificial Sequence: Chemically synthesized oligonucleotide
cgattccgctgagacccca

SEQ ID NO: 7384 - DNA, 19 bp, Artificial Sequence
  Description of Artificial Sequence: Chemically synthesized oligonucleotide
tggggtctcagcggaatcg

SEQ ID NO: 7385 - DNA, 19 bp, Artificial Sequence
  Description of Artificial Sequence: Chemically synthesized oligonucleotide
gattccgctgagaccccag

SEQ ID NO: 7386 - DNA, 19 bp, Artificial Sequence
  Description of Artificial Sequence: Chemically synthesized oligonucleotide
ctggggtctcagcggaatc

SEQ ID NO: 7387 - DNA, 19 bp, Artificial Sequence
  Description of Artificial Sequence: Chemically synthesized oligonucleotide
attccgctgagaccccagc

SEQ ID NO: 7388 - DNA, 19 bp, Artificial Sequence
  Description of Artificial Sequence: Chemically synthesized oligonucleotide
gctggggtctcagcggaat

SEQ ID NO: 7389 - DNA, 19 bp, Artificial Sequence
  Description of Artificial Sequence: Chemically synthesized oligonucleotide
ttccgctgagaccccagca

SEQ ID NO: 7390 - DNA, 19 bp, Artificial Sequence
  Description of Artificial Sequence: Chemically synthesized oligonucleotide
tgctggggtctcagcggaa

SEQ ID NO: 7391 - DNA, 19 bp, Artificial Sequence
  Description of Artificial Sequence: Chemically synthesized oligonucleotide
tccgctgagaccccagcag

SEQ ID NO: 7392 - DNA, 19 bp, Artificial Sequence
  Description of Artificial Sequence: Chemically synthesized oligonucleotide
ctgctggggtctcagcgga

SEQ ID NO: 7393 - DNA, 19 bp, Artificial Sequence
  Description of Artificial Sequence: Chemically synthesized oligonucleotide
ccgctgagaccccagcaga

SEQ ID NO: 7394 - DNA, 19 bp, Artificial Sequence
  Description of Artificial Sequence: Chemically synthesized oligonucleotide
tctgctggggtctcagcgg

SEQ ID NO: 7395 - DNA, 19 bp, Artificial Sequence
  Description of Artificial Sequence: Chemically synthesized oligonucleotide
cgctgagaccccagcagag

SEQ ID NO: 7396 - DNA, 19 bp, Artificial Sequence
  Description of Artificial Sequence: Chemically synthesized oligonucleotide
ctctgctggggtctcagcg

SEQ ID NO: 7397 - DNA, 19 bp, Artificial Sequence
  Description of Artificial Sequence: Chemically synthesized oligonucleotide
gctgagaccccagcagagg

SEQ ID NO: 7398 - DNA, 19 bp, Artificial Sequence
  Description of Artificial Sequence: Chemically synthesized oligonucleotide
cctctgctggggtctcagc

SEQ ID NO: 7399 - DNA, 19 bp, Artificial Sequence
  Description of Artificial Sequence: Chemically synthesized oligonucleotide
ctgagaccccagcagagga

SEQ ID NO: 7400 - DNA, 19 bp, Artificial Sequence
  Description of Artificial Sequence: Chemically synthesized oligonucleotide
tcctctgctggggtctcag

SEQ ID NO: 7401 - DNA, 19 bp, Artificial Sequence
  Description of Artificial Sequence: Chemically synthesized oligonucleotide
tgagaccccagcagaggac

SEQ ID NO: 7402 - DNA, 19 bp, Artificial Sequence
  Description of Artificial Sequence: Chemically synthesized oligonucleotide
gtcctctgctggggtctca

SEQ ID NO: 7403 - DNA, 19 bp, Artificial Sequence
  Description of Artificial Sequence: Chemically synthesized oligonucleotide
gagaccccagcagaggacc

SEQ ID NO: 7404 - DNA, 19 bp, Artificial Sequence
  Description of Artificial Sequence: Chemically synthesized oligonucleotide
ggtcctctgctggggtctc

SEQ ID NO: 7405 - DNA, 19 bp, Artificial Sequence
  Description of Artificial Sequence: Chemically synthesized oligonucleotide
agaccccagcagaggaccg

SEQ ID NO: 7406 - DNA, 19 bp, Artificial Sequence
  Description of Artificial Sequence: Chemically synthesized oligonucleotide
cggtcctctgctggggtct

SEQ ID NO: 7407 - DNA, 19 bp, Artificial Sequence
  Description of Artificial Sequence: Chemically synthesized oligonucleotide
gaccccagcagaggaccgt

SEQ ID NO: 7408 - DNA, 19 bp, Artificial Sequence
  Description of Artificial Sequence: Chemically synthesized oligonucleotide
acggtcctctgctggggtc

SEQ ID NO: 7409 - DNA, 19 bp, Artificial Sequence
  Description of Artificial Sequence: Chemically synthesized oligonucleotide
accccagcagaggaccgtg

SEQ ID NO: 7410 - DNA, 19 bp, Artificial Sequence
  Description of Artificial Sequence: Chemically synthesized oligonucleotide
cacggtcctctgctggggt

SEQ ID NO: 7411 - DNA, 19 bp, Artificial Sequence
  Description of Artificial Sequence: Chemically synthesized oligonucleotide
ccccagcagaggaccgtgc

SEQ ID NO: 7412 - DNA, 19 bp, Artificial Sequence
  Description of Artificial Sequence: Chemically synthesized oligonucleotide
gcacggtcctctgctgggg

SEQ ID NO: 7413 - DNA, 19 bp, Artificial Sequence
  Description of Artificial Sequence: Chemically synthesized oligonucleotide
cccagcagaggaccgtgct

SEQ ID NO: 7414 - DNA, 19 bp, Artificial Sequence
  Description of Artificial Sequence: Chemically synthesized oligonucleotide
agcacggtcctctgctggg

SEQ ID NO: 7415 - DNA, 19 bp, Artificial Sequence
  Description of Artificial Sequence: Chemically synthesized oligonucleotide
ccagcagaggaccgtgctg

SEQ ID NO: 7416 - DNA, 19 bp, Artificial Sequence
  Description of Artificial Sequence: Chemically synthesized oligonucleotide
cagcacggtcctctgctgg

SEQ ID NO: 7417 - DNA, 19 bp, Artificial Sequence
  Description of Artificial Sequence: Chemically synthesized oligonucleotide
cagcagaggaccgtgctgg

SEQ ID NO: 7418 - DNA, 19 bp, Artificial Sequence
  Description of Artificial Sequence: Chemically synthesized oligonucleotide
ccagcacggtcctctgctg

SEQ ID NO: 7419 - DNA, 19 bp, Artificial Sequence
  Description of Artificial Sequence: Chemically synthesized oligonucleotide
agcagaggaccgtgctggc

SEQ ID NO: 7420 - DNA, 19 bp, Artificial Sequence
  Description of Artificial Sequence: Chemically synthesized oligonucleotide
gccagcacggtcctctgct

SEQ ID NO: 7421 - DNA, 19 bp, Artificial Sequence
  Description of Artificial Sequence: Chemically synthesized oligonucleotide
gcagaggaccgtgctggcc

SEQ ID NO: 7422 - DNA, 19 bp, Artificial Sequence
  Description of Artificial Sequence: Chemically synthesized oligonucleotide
ggccagcacggtcctctgc

SEQ ID NO: 7423 - DNA, 19 bp, Artificial Sequence
  Description of Artificial Sequence: Chemically synthesized oligonucleotide
cagaggaccgtgctggccg

SEQ ID NO: 7424 - DNA, 19 bp, Artificial Sequence
  Description of Artificial Sequence: Chemically synthesized oligonucleotide
cggccagcacggtcctctg

SEQ ID NO: 7425 - DNA, 19 bp, Artificial Sequence
  Description of Artificial Sequence: Chemically synthesized oligonucleotide
agaggaccgtgctggccga

SEQ ID NO: 7426 - DNA, 19 bp, Artificial Sequence
  Description of Artificial Sequence: Chemically synthesized oligonucleotide
tcggccagcacggtcctct

SEQ ID NO: 7427 - DNA, 19 bp, Artificial Sequence
  Description of Artificial Sequence: Chemically synthesized oligonucleotide
gaggaccgtgctggccgag

SEQ ID NO: 7428 - DNA, 19 bp, Artificial Sequence
  Description of Artificial Sequence: Chemically synthesized oligonucleotide
ctcggccagcacggtcctc

SEQ ID NO: 7429 - DNA, 19 bp, Artificial Sequence
  Description of Artificial Sequence: Chemically synthesized oligonucleotide
aggaccgtgctggccgagg

SEQ ID NO: 7430 - DNA, 19 bp, Artificial Sequence
  Description of Artificial Sequence: Chemically synthesized oligonucleotide
cctcggccagcacggtcct

SEQ ID NO: 7431 - DNA, 19 bp, Artificial Sequence
  Description of Artificial Sequence: Chemically synthesized oligonucleotide
ggaccgtgctggccgaggg

SEQ ID NO: 7432 - DNA, 19 bp, Artificial Sequence
  Description of Artificial Sequence: Chemically synthesized oligonucleotide
ccctcggccagcacggtcc

SEQ ID NO: 7433 - DNA, 19 bp, Artificial Sequence
  Description of Artificial Sequence: Chemically synthesized oligonucleotide
gaccgtgctggccgagggc

SEQ ID NO: 7434 - DNA, 19 bp, Artificial Sequence
  Description of Artificial Sequence: Chemically synthesized oligonucleotide
gccctcggccagcacggtc

SEQ ID NO: 7435 - DNA, 19 bp, Artificial Sequence
  Description of Artificial Sequence: Chemically synthesized oligonucleotide
accgtgctggccgagggcc

SEQ ID NO: 7436 - DNA, 19 bp, Artificial Sequence
  Description of Artificial Sequence: Chemically synthesized oligonucleotide
ggccctcggccagcacggt

SEQ ID NO: 7437 - DNA, 19 bp, Artificial Sequence
  Description of Artificial Sequence: Chemically synthesized oligonucleotide
ccgtgctggccgagggccc

SEQ ID NO: 7438 - DNA, 19 bp, Artificial Sequence
  Description of Artificial Sequence: Chemically synthesized oligonucleotide
gggccctcggccagcacgg

SEQ ID NO: 7439 - DNA, 19 bp, Artificial Sequence
  Description of Artificial Sequence: Chemically synthesized oligonucleotide
cgtgctggccgagggcccc

SEQ ID NO: 7440 - DNA, 19 bp, Artificial Sequence
  Description of Artificial Sequence: Chemically synthesized oligonucleotide
ggggccctcggccagcacg

SEQ ID NO: 7441 - DNA, 19 bp, Artificial Sequence
  Description of Artificial Sequence: Chemically synthesized oligonucleotide
gtgctggccgagggcccct

SEQ ID NO: 7442 - DNA, 19 bp, Artificial Sequence
  Description of Artificial Sequence: Chemically synthesized oligonucleotide
aggggccctcggccagcac

SEQ ID NO: 7443 - DNA, 19 bp, Artificial Sequence
  Description of Artificial Sequence: Chemically synthesized oligonucleotide
tgctggccgagggcccctg

SEQ ID NO: 7444 - DNA, 19 bp, Artificial Sequence
  Description of Artificial Sequence: Chemically synthesized oligonucleotide
caggggccctcggccagca

SEQ ID NO: 7445 - DNA, 19 bp, Artificial Sequence
  Description of Artificial Sequence: Chemically synthesized oligonucleotide
gctggccgagggcccctgc

SEQ ID NO: 7446 - DNA, 19 bp, Artificial Sequence
  Description of Artificial Sequence: Chemically synthesized oligonucleotide
gcaggggccctcggccagc

SEQ ID NO: 7447 - DNA, 19 bp, Artificial Sequence
  Description of Artificial Sequence: Chemically synthesized oligonucleotide
ctggccgagggcccctgcc

SEQ ID NO: 7448 - DNA, 19 bp, Artificial Sequence
  Description of Artificial Sequence: Chemically synthesized oligonucleotide
ggcaggggccctcggccag

SEQ ID NO: 7449 - DNA, 19 bp, Artificial Sequence
  Description of Artificial Sequence: Chemically synthesized oligonucleotide
tggccgagggcccctgcct

SEQ ID NO: 7450 - DNA, 19 bp, Artificial Sequence
  Description of Artificial Sequence: Chemically synthesized oligonucleotide
aggcaggggccctcggcca

SEQ ID NO: 7451 - DNA, 19 bp, Artificial Sequence
  Description of Artificial Sequence: Chemically synthesized oligonucleotide
ggccgagggcccctgcctt

SEQ ID NO: 7452 - DNA, 19 bp, Artificial Sequence
  Description of Artificial Sequence: Chemically synthesized oligonucleotide
aaggcaggggccctcggcc

SEQ ID NO: 7453 - DNA, 19 bp, Artificial Sequence
  Description of Artificial Sequence: Chemically synthesized oligonucleotide
gccgagggcccctgccttg

SEQ ID NO: 7454 - DNA, 19 bp, Artificial Sequence
  Description of Artificial Sequence: Chemically synthesized oligonucleotide
caaggcaggggccctcggc

SEQ ID NO: 7455 - DNA, 19 bp, Artificial Sequence
  Description of Artificial Sequence: Chemically synthesized oligonucleotide
ccgagggcccctgccttgt

SEQ ID NO: 7456 - DNA, 19 bp, Artificial Sequence
  Description of Artificial Sequence: Chemically synthesized oligonucleotide
acaaggcaggggccctcgg

SEQ ID NO: 7457 - DNA, 19 bp, Artificial Sequence
  Description of Artificial Sequence: Chemically synthesized oligonucleotide
cgagggcccctgccttgtc

SEQ ID NO: 7458 - DNA, 19 bp, Artificial Sequence
  Description of Artificial Sequence: Chemically synthesized oligonucleotide
gacaaggcaggggccctcg

SEQ ID NO: 7459 - DNA, 19 bp, Artificial Sequence
  Description of Artificial Sequence: Chemically synthesized oligonucleotide
gagggcccctgccttgtcc

SEQ ID NO: 7460 - DNA, 19 bp, Artificial Sequence
  Description of Artificial Sequence: Chemically synthesized oligonucleotide
ggacaaggcaggggccctc

SEQ ID NO: 7461 - DNA, 19 bp, Artificial Sequence
  Description of Artificial Sequence: Chemically synthesized oligonucleotide
agggcccctgccttgtcct

SEQ ID NO: 7462 - DNA, 19 bp, Artificial Sequence
  Description of Artificial Sequence: Chemically synthesized oligonucleotide
aggacaaggcaggggccct

SEQ ID NO: 7463 - DNA, 19 bp, Artificial Sequence
  Description of Artificial Sequence: Chemically synthesized oligonucleotide
gggcccctgccttgtcctt

SEQ ID NO: 7464 - DNA, 19 bp, Artificial Sequence
  Description of Artificial Sequence: Chemically synthesized oligonucleotide
aaggacaaggcaggggccc

SEQ ID NO: 7465 - DNA, 19 bp, Artificial Sequence
  Description of Artificial Sequence: Chemically synthesized oligonucleotide
ggcccctgccttgtccttc

SEQ ID NO: 7466 - DNA, 19 bp, Artificial Sequence
  Description of Artificial Sequence: Chemically synthesized oligonucleotide
gaaggacaaggcaggggcc

SEQ ID NO: 7467 - DNA, 19 bp, Artificial Sequence
  Description of Artificial Sequence: Chemically synthesized oligonucleotide
gcccctgccttgtccttct

SEQ ID NO: 7468 - DNA, 19 bp, Artificial Sequence
  Description of Artificial Sequence: Chemically synthesized oligonucleotide
agaaggacaaggcaggggc

SEQ ID NO: 7469 - DNA, 19 bp, Artificial Sequence
  Description of Artificial Sequence: Chemically synthesized oligonucleotide
cccctgccttgtccttctc

SEQ ID NO: 7470 - DNA, 19 bp, Artificial Sequence
  Description of Artificial Sequence: Chemically synthesized oligonucleotide
gagaaggacaaggcagggg

SEQ ID NO: 7471 - DNA, 19 bp, Artificial Sequence
  Description of Artificial Sequence: Chemically synthesized oligonucleotide
ccctgccttgtccttctct

SEQ ID NO: 7472 - DNA, 19 bp, Artificial Sequence
  Description of Artificial Sequence: Chemically synthesized oligonucleotide
agagaaggacaaggcaggg

SEQ ID NO: 7473 - DNA, 19 bp, Artificial Sequence
  Description of Artificial Sequence: Chemically synthesized oligonucleotide
cctgccttgtccttctctc

SEQ ID NO: 7474 - DNA, 19 bp, Artificial Sequence
  Description of Artificial Sequence: Chemically synthesized oligonucleotide
gagagaaggacaaggcagg

SEQ ID NO: 7475 - DNA, 19 bp, Artificial Sequence
  Description of Artificial Sequence: Chemically synthesized oligonucleotide
ctgccttgtccttctctct

SEQ ID NO: 7476 - DNA, 19 bp, Artificial Sequence
  Description of Artificial Sequence: Chemically synthesized oligonucleotide
agagagaaggacaaggcag

SEQ ID NO: 7477 - DNA, 19 bp, Artificial Sequence
  Description of Artificial Sequence: Chemically synthesized oligonucleotide
tgccttgtccttctctctg

SEQ ID NO: 7478 - DNA, 19 bp, Artificial Sequence
  Description of Artificial Sequence: Chemically synthesized oligonucleotide
cagagagaaggacaaggca

SEQ ID NO: 7479 - DNA, 19 bp, Artificial Sequence
  Description of Artificial Sequence: Chemically synthesized oligonucleotide
gccttgtccttctctctgc

SEQ ID NO: 7480 - DNA, 19 bp, Artificial Sequence
  Description of Artificial Sequence: Chemically synthesized oligonucleotide
gcagagagaaggacaaggc

SEQ ID NO: 7481 - DNA, 19 bp, Artificial Sequence
  Description of Artificial Sequence: Chemically synthesized oligonucleotide
ccttgtccttctctctgcg

SEQ ID NO: 7482 - DNA, 19 bp, Artificial Sequence
  Description of Artificial Sequence: Chemically synthesized oligonucleotide
cgcagagagaaggacaagg

SEQ ID NO: 7483 - DNA, 19 bp, Artificial Sequence
  Description of Artificial Sequence: Chemically synthesized oligonucleotide
cttgtccttctctctgcga

SEQ ID NO: 7484 - DNA, 19 bp, Artificial Sequence
  Description of Artificial Sequence: Chemically synthesized oligonucleotide
tcgcagagagaaggacaag

SEQ ID NO: 7485 - DNA, 19 bp, Artificial Sequence
  Description of Artificial Sequence: Chemically synthesized oligonucleotide
ttgtccttctctctgcgaa

SEQ ID NO: 7486 - DNA, 19 bp, Artificial Sequence
  Description of Artificial Sequence: Chemically synthesized oligonucleotide
ttcgcagagagaaggacaa

SEQ ID NO: 7487 - DNA, 19 bp, Artificial Sequence
  Description of Artificial Sequence: Chemically synthesized oligonucleotide
tgtccttctctctgcgaac

SEQ ID NO: 7488 - DNA, 19 bp, Artificial Sequence
  Description of Artificial Sequence: Chemically synthesized oligonucleotide
gttcgcagagagaaggaca

SEQ ID NO: 7489 - DNA, 19 bp, Artificial Sequence
  Description of Artificial Sequence: Chemically synthesized oligonucleotide
gtccttctctctgcgaact

SEQ ID NO: 7490 - DNA, 19 bp, Artificial Sequence
  Description of Artificial Sequence: Chemically synthesized oligonucleotide
agttcgcagagagaaggac

SEQ ID NO: 7491 - DNA, 19 bp, Artificial Sequence
  Description of Artificial Sequence: Chemically synthesized oligonucleotide
tccttctctctgcgaactg

SEQ ID NO: 7492 - DNA, 19 bp, Artificial Sequence
  Description of Artificial Sequence: Chemically synthesized oligonucleotide
cagttcgcagagagaagga

SEQ ID NO: 7493 - DNA, 19 bp, Artificial Sequence
  Description of Artificial Sequence: Chemically synthesized oligonucleotide
ccttctctctgcgaactgc

SEQ ID NO: 7494 - DNA, 19 bp, Artificial Sequence
  Description of Artificial Sequence: Chemically synthesized oligonucleotide
gcagttcgcagagagaagg

SEQ ID NO: 7495 - DNA, 19 bp, Artificial Sequence
  Description of Artificial Sequence: Chemically synthesized oligonucleotide
cttctctctgcgaactgct

SEQ ID NO: 7496 - DNA, 19 bp, Artificial Sequence
  Description of Artificial Sequence: Chemically synthesized oligonucleotide
agcagttcgcagagagaag

SEQ ID NO: 7497 - DNA, 19 bp, Artificial Sequence
  Description of Artificial Sequence: Chemically synthesized oligonucleotide
ttctctctgcgaactgctg

SEQ ID NO: 7498 - DNA, 19 bp, Artificial Sequence
  Description of Artificial Sequence: Chemically synthesized oligonucleotide
cagcagttcgcagagagaa

SEQ ID NO: 7499 - DNA, 19 bp, Artificial Sequence
  Description of Artificial Sequence: Chemically synthesized oligonucleotide
tctctctgcgaactgctgg

SEQ ID NO: 7500 - DNA, 19 bp, Artificial Sequence
  Description of Artificial Sequence: Chemically synthesized oligonucleotide
ccagcagttcgcagagaga

SEQ ID NO: 7501 - DNA, 19 bp, Artificial Sequence
  Description of Artificial Sequence: Chemically synthesized oligonucleotide
ctctctgcgaactgctggc

SEQ ID NO: 7502 - DNA, 19 bp, Artificial Sequence
  Description of Artificial Sequence: Chemically synthesized oligonucleotide
gccagcagttcgcagagag

SEQ ID NO: 7503 - DNA, 19 bp, Artificial Sequence
  Description of Artificial Sequence: Chemically synthesized oligonucleotide
tctctgcgaactgctggct

SEQ ID NO: 7504 - DNA, 19 bp, Artificial Sequence
  Description of Artificial Sequence: Chemically synthesized oligonucleotide
agccagcagttcgcagaga

SEQ ID NO: 7505 - DNA, 19 bp, Artificial Sequence
  Description of Artificial Sequence: Chemically synthesized oligonucleotide
ctctgcgaactgctggctt

SEQ ID NO: 7506 - DNA, 19 bp, Artificial Sequence
  Description of Artificial Sequence: Chemically synthesized oligonucleotide
aagccagcagttcgcagag

SEQ ID NO: 7507 - DNA, 19 bp, Artificial Sequence
  Description of Artificial Sequence: Chemically synthesized oligonucleotide
tctgcgaactgctggcttc

SEQ ID NO: 7508 - DNA, 19 bp, Artificial Sequence
  Description of Artificial Sequence: Chemically synthesized oligonucleotide
gaagccagcagttcgcaga

SEQ ID NO: 7509 - DNA, 19 bp, Artificial Sequence
  Description of Artificial Sequence: Chemically synthesized oligonucleotide
ctgcgaactgctggcttct

SEQ ID NO: 7510 - DNA, 19 bp, Artificial Sequence
  Description of Artificial Sequence: Chemically synthesized oligonucleotide
agaagccagcagttcgcag

SEQ ID NO: 7511 - DNA, 19 bp, Artificial Sequence
  Description of Artificial Sequence: Chemically synthesized oligonucleotide
tgcgaactgctggcttcta

SEQ ID NO: 7512 - DNA, 19 bp, Artificial Sequence
  Description of Artificial Sequence: Chemically synthesized oligonucleotide
tagaagccagcagttcgca

SEQ ID NO: 7513 - DNA, 19 bp, Artificial Sequence
  Description of Artificial Sequence: Chemically synthesized oligonucleotide
gcgaactgctggcttctac

SEQ ID NO: 7514 - DNA, 19 bp, Artificial Sequence
  Description of Artificial Sequence: Chemically synthesized oligonucleotide
gtagaagccagcagttcgc

SEQ ID NO: 7515 - DNA, 19 bp, Artificial Sequence
  Description of Artificial Sequence: Chemically synthesized oligonucleotide
cgaactgctggcttctacc

SEQ ID NO: 7516 - DNA, 19 bp, Artificial Sequence
  Description of Artificial Sequence: Chemically synthesized oligonucleotide
ggtagaagccagcagttcg

SEQ ID NO: 7517 - DNA, 19 bp, Artificial Sequence
  Description of Artificial Sequence: Chemically synthesized oligonucleotide
gaactgctggcttctaccg

SEQ ID NO: 7518 - DNA, 19 bp, Artificial Sequence
  Description of Artificial Sequence: Chemically synthesized oligonucleotide
cggtagaagccagcagttc

SEQ ID NO: 7519 - DNA, 19 bp, Artificial Sequence
  Description of Artificial Sequence: Chemically synthesized oligonucleotide
aactgctggcttctaccgc

SEQ ID NO: 7520 - DNA, 19 bp, Artificial Sequence
  Description of Artificial Sequence: Chemically synthesized oligonucleotide
gcggtagaagccagcagtt

SEQ ID NO: 7521 - DNA, 19 bp, Artificial Sequence
  Description of Artificial Sequence: Chemically synthesized oligonucleotide
actgctggcttctaccgcg

SEQ ID NO: 7522 - DNA, 19 bp, Artificial Sequence
  Description of Artificial Sequence: Chemically synthesized oligonucleotide
cgcggtagaagccagcagt

SEQ ID NO: 7523 - DNA, 19 bp, Artificial Sequence
  Description of Artificial Sequence: Chemically synthesized oligonucleotide
ctgctggcttctaccgcgg

SEQ ID NO: 7524 - DNA, 19 bp, Artificial Sequence
  Description of Artificial Sequence: Chemically synthesized oligonucleotide
ccgcggtagaagccagcag

SEQ ID NO: 7525 - DNA, 19 bp, Artificial Sequence
  Description of Artificial Sequence: Chemically synthesized oligonucleotide
tgctggcttctaccgcggt

SEQ ID NO: 7526 - DNA, 19 bp, Artificial Sequence
  Description of Artificial Sequence: Chemically synthesized oligonucleotide
accgcggtagaagccagca

SEQ ID NO: 7527 - DNA, 19 bp, Artificial Sequence
  Description of Artificial Sequence: Chemically synthesized oligonucleotide
gctggcttctaccgcggtc

SEQ ID NO: 7528 - DNA, 19 bp, Artificial Sequence
  Description of Artificial Sequence: Chemically synthesized oligonucleotide
gaccgcggtagaagccagc

SEQ ID NO: 7529 - DNA, 19 bp, Artificial Sequence
  Description of Artificial Sequence: Chemically synthesized oligonucleotide
ctggcttctaccgcggtca

SEQ ID NO: 7530 - DNA, 19 bp, Artificial Sequence
  Description of Artificial Sequence: Chemically synthesized oligonucleotide
tgaccgcggtagaagccag

SEQ ID NO: 7531 - DNA, 19 bp, Artificial Sequence
  Description of Artificial Sequence: Chemically synthesized oligonucleotide
tggcttctaccgcggtcaa

SEQ ID NO: 7532 - DNA, 19 bp, Artificial Sequence
  Description of Artificial Sequence: Chemically synthesized oligonucleotide
ttgaccgcggtagaagcca

SEQ ID NO: 7533 - DNA, 19 bp, Artificial Sequence
  Description of Artificial Sequence: Chemically synthesized oligonucleotide
ggcttctaccgcggtcaaa

SEQ ID NO: 7534 - DNA, 19 bp, Artificial Sequence
  Description of Artificial Sequence: Chemically synthesized oligonucleotide
tttgaccgcggtagaagcc

SEQ ID NO: 7535 - DNA, 19 bp, Artificial Sequence
  Description of Artificial Sequence: Chemically synthesized oligonucleotide
gcttctaccgcggtcaaac

SEQ ID NO: 7536 - DNA, 19 bp, Artificial Sequence
  Description of Artificial Sequence: Chemically synthesized oligonucleotide
gtttgaccgcggtagaagc

SEQ ID NO: 7537 - DNA, 19 bp, Artificial Sequence
  Description of Artificial Sequence: Chemically synthesized oligonucleotide
cttctaccgcggtcaaact

SEQ ID NO: 7538 - DNA, 19 bp, Artificial Sequence
  Description of Artificial Sequence: Chemically synthesized oligonucleotide
agtttgaccgcggtagaag

SEQ ID NO: 7539 - DNA, 19 bp, Artificial Sequence
  Description of Artificial Sequence: Chemically synthesized oligonucleotide
ttctaccgcggtcaaactc

SEQ ID NO: 7540 - DNA, 19 bp, Artificial Sequence
  Description of Artificial Sequence: Chemically synthesized oligonucleotide
gagtttgaccgcggtagaa

SEQ ID NO: 7541 - DNA, 19 bp, Artificial Sequence
  Description of Artificial Sequence: Chemically synthesized oligonucleotide
tctaccgcggtcaaactct

SEQ ID NO: 7542 - DNA, 19 bp, Artificial Sequence
  Description of Artificial Sequence: Chemically synthesized oligonucleotide
agagtttgaccgcggtaga

SEQ ID NO: 7543 - DNA, 19 bp, Artificial Sequence
  Description of Artificial Sequence: Chemically synthesized oligonucleotide
ctaccgcggtcaaactctg

SEQ ID NO: 7544 - DNA, 19 bp, Artificial Sequence
  Description of Artificial Sequence: Chemically synthesized oligonucleotide
cagagtttgaccgcggtag

SEQ ID NO: 7545 - DNA, 19 bp, Artificial Sequence
  Description of Artificial Sequence: Chemically synthesized oligonucleotide
taccgcggtcaaactctgc

SEQ ID NO: 7546 - DNA, 19 bp, Artificial Sequence
  Description of Artificial Sequence: Chemically synthesized oligonucleotide
gcagagtttgaccgcggta

SEQ ID NO: 7547 - DNA, 19 bp, Artificial Sequence
  Description of Artificial Sequence: Chemically synthesized oligonucleotide
accgcggtcaaactctgct

SEQ ID NO: 7548 - DNA, 19 bp, Artificial Sequence
  Description of Artificial Sequence: Chemically synthesized oligonucleotide
agcagagtttgaccgcggt

SEQ ID NO: 7549 - DNA, 19 bp, Artificial Sequence
  Description of Artificial Sequence: Chemically synthesized oligonucleotide
ccgcggtcaaactctgctt

SEQ ID NO: 7550 - DNA, 19 bp, Artificial Sequence
  Description of Artificial Sequence: Chemically synthesized oligonucleotide
aagcagagtttgaccgcgg

SEQ ID NO: 7551 - DNA, 19 bp, Artificial Sequence
  Description of Artificial Sequence: Chemically synthesized oligonucleotide
cgcggtcaaactctgcttg

SEQ ID NO: 7552 - DNA, 19 bp, Artificial Sequence
  Description of Artificial Sequence: Chemically synthesized oligonucleotide
caagcagagtttgaccgcg

SEQ ID NO: 7553 - DNA, 19 bp, Artificial Sequence
  Description of Artificial Sequence: Chemically synthesized oligonucleotide
gcggtcaaactctgcttgg

SEQ ID NO: 7554 - DNA, 19 bp, Artificial Sequence
  Description of Artificial Sequence: Chemically synthesized oligonucleotide
ccaagcagagtttgaccgc

SEQ ID NO: 7555 - DNA, 19 bp, Artificial Sequence
  Description of Artificial Sequence: Chemically synthesized oligonucleotide
cggtcaaactctgcttggg

SEQ ID NO: 7556 - DNA, 19 bp, Artificial Sequence
  Description of Artificial Sequence: Chemically synthesized oligonucleotide
cccaagcagagtttgaccg

SEQ ID NO: 7557 - DNA, 19 bp, Artificial Sequence
  Description of Artificial Sequence: Chemically synthesized oligonucleotide
ggtcaaactctgcttgggc

SEQ ID NO: 7558 - DNA, 19 bp, Artificial Sequence
  Description of Artificial Sequence: Chemically synthesized oligonucleotide
gcccaagcagagtttgacc

SEQ ID NO: 7559 - DNA, 19 bp, Artificial Sequence
  Description of Artificial Sequence: Chemically synthesized oligonucleotide
gtcaaactctgcttgggcc

SEQ ID NO: 7560 - DNA, 19 bp, Artificial Sequence
  Description of Artificial Sequence: Chemically synthesized oligonucleotide
ggcccaagcagagtttgac

SEQ ID NO: 7561 - DNA, 19 bp, Artificial Sequence
  Description of Artificial Sequence: Chemically synthesized oligonucleotide
tcaaactctgcttgggcca

SEQ ID NO: 7562 - DNA, 19 bp, Artificial Sequence
  Description of Artificial Sequence: Chemically synthesized oligonucleotide
tggcccaagcagagtttga

SEQ ID NO: 7563 - DNA, 19 bp, Artificial Sequence
  Description of Artificial Sequence: Chemically synthesized oligonucleotide
caaactctgcttgggccat

SEQ ID NO: 7564 - DNA, 19 bp, Artificial Sequence
  Description of Artificial Sequence: Chemically synthesized oligonucleotide
atggcccaagcagagtttg

SEQ ID NO: 7565 - DNA, 19 bp, Artificial Sequence
  Description of Artificial Sequence: Chemically synthesized oligonucleotide
aaactctgcttgggccatg

SEQ ID NO: 7566 - DNA, 19 bp, Artificial Sequence
  Description of Artificial Sequence: Chemically synthesized oligonucleotide
catggcccaagcagagttt

SEQ ID NO: 7567 - DNA, 19 bp, Artificial Sequence
  Description of Artificial Sequence: Chemically synthesized oligonucleotide
aactctgcttgggccatga

SEQ ID NO: 7568 - DNA, 19 bp, Artificial Sequence
  Description of Artificial Sequence: Chemically synthesized oligonucleotide
tcatggcccaagcagagtt

SEQ ID NO: 7569 - DNA, 19 bp, Artificial Sequence
  Description of Artificial Sequence: Chemically synthesized oligonucleotide
actctgcttgggccatgag

SEQ ID NO: 7570 - DNA, 19 bp, Artificial Sequence
  Description of Artificial Sequence: Chemically synthesized oligonucleotide
ctcatggcccaagcagagt

SEQ ID NO: 7571 - DNA, 19 bp, Artificial Sequence
  Description of Artificial Sequence: Chemically synthesized oligonucleotide
ctctgcttgggccatgagc

SEQ ID NO: 7572 - DNA, 19 bp, Artificial Sequence
  Description of Artificial Sequence: Chemically synthesized oligonucleotide
gctcatggcccaagcagag

SEQ ID NO: 7573 - DNA, 19 bp, Artificial Sequence
  Description of Artificial Sequence: Chemically synthesized oligonucleotide
tctgcttgggccatgagcg

SEQ ID NO: 7574 - DNA, 19 bp, Artificial Sequence
  Description of Artificial Sequence: Chemically synthesized oligonucleotide
cgctcatggcccaagcaga

SEQ ID NO: 7575 - DNA, 19 bp, Artificial Sequence
  Description of Artificial Sequence: Chemically synthesized oligonucleotide
ctgcttgggccatgagcga

SEQ ID NO: 7576 - DNA, 19 bp, Artificial Sequence
  Description of Artificial Sequence: Chemically synthesized oligonucleotide
tcgctcatggcccaagcag

SEQ ID NO: 7577 - DNA, 19 bp, Artificial Sequence
  Description of Artificial Sequence: Chemically synthesized oligonucleotide
tgcttgggccatgagcgaa

SEQ ID NO: 7578 - DNA, 19 bp, Artificial Sequence
  Description of Artificial Sequence: Chemically synthesized oligonucleotide
ttcgctcatggcccaagca

SEQ ID NO: 7579 - DNA, 19 bp, Artificial Sequence
  Description of Artificial Sequence: Chemically synthesized oligonucleotide
gcttgggccatgagcgaat

SEQ ID NO: 7580 - DNA, 19 bp, Artificial Sequence
  Description of Artificial Sequence: Chemically synthesized oligonucleotide
attcgctcatggcccaagc

SEQ ID NO: 7581 - DNA, 19 bp, Artificial Sequence
  Description of Artificial Sequence: Chemically synthesized oligonucleotide
cttgggccatgagcgaata

SEQ ID NO: 7582 - DNA, 19 bp, Artificial Sequence
  Description of Artificial Sequence: Chemically synthesized oligonucleotide
tattcgctcatggcccaag

SEQ ID NO: 7583 - DNA, 19 bp, Artificial Sequence
  Description of Artificial Sequence: Chemically synthesized oligonucleotide
ttgggccatgagcgaatac

SEQ ID NO: 7584 - DNA, 19 bp, Artificial Sequence
  Description of Artificial Sequence: Chemically synthesized oligonucleotide
gtattcgctcatggcccaa

SEQ ID NO: 7585 - DNA, 19 bp, Artificial Sequence
  Description of Artificial Sequence: Chemically synthesized oligonucleotide
tgggccatgagcgaataca

SEQ ID NO: 7586 - DNA, 19 bp, Artificial Sequence
  Description of Artificial Sequence: Chemically synthesized oligonucleotide
tgtattcgctcatggccca

SEQ ID NO: 7587 - DNA, 19 bp, Artificial Sequence
  Description of Artificial Sequence: Chemically synthesized oligonucleotide
gggccatgagcgaatacac

SEQ ID NO: 7588 - DNA, 19 bp, Artificial Sequence
  Description of Artificial Sequence: Chemically synthesized oligonucleotide
gtgtattcgctcatggccc

SEQ ID NO: 7589 - DNA, 19 bp, Artificial Sequence
  Description of Artificial Sequence: Chemically synthesized oligonucleotide
ggccatgagcgaatacaca

SEQ ID NO: 7590 - DNA, 19 bp, Artificial Sequence
  Description of Artificial Sequence: Chemically synthesized oligonucleotide
tgtgtattcgctcatggcc

SEQ ID NO: 7591 - DNA, 19 bp, Artificial Sequence
  Description of Artificial Sequence: Chemically synthesized oligonucleotide
gccatgagcgaatacacat

SEQ ID NO: 7592 - DNA, 19 bp, Artificial Sequence
  Description of Artificial Sequence: Chemically synthesized oligonucleotide
atgtgtattcgctcatggc

SEQ ID NO: 7593 - DNA, 19 bp, Artificial Sequence
  Description of Artificial Sequence: Chemically synthesized oligonucleotide
ccatgagcgaatacacatg

SEQ ID NO: 7594 - DNA, 19 bp, Artificial Sequence
  Description of Artificial Sequence: Chemically synthesized oligonucleotide
catgtgtattcgctcatgg

SEQ ID NO: 7595 - DNA, 19 bp, Artificial Sequence
  Description of Artificial Sequence: Chemically synthesized oligonucleotide
catgagcgaatacacatgg

SEQ ID NO: 7596 - DNA, 19 bp, Artificial Sequence
  Description of Artificial Sequence: Chemically synthesized oligonucleotide
ccatgtgtattcgctcatg

SEQ ID NO: 7597 - DNA, 19 bp, Artificial Sequence
  Description of Artificial Sequence: Chemically synthesized oligonucleotide
atgagcgaatacacatggc

SEQ ID NO: 7598 - DNA, 19 bp, Artificial Sequence
  Description of Artificial Sequence: Chemically synthesized oligonucleotide
gccatgtgtattcgctcat

SEQ ID NO: 7599 - DNA, 19 bp, Artificial Sequence
  Description of Artificial Sequence: Chemically synthesized oligonucleotide
tgagcgaatacacatggcc

SEQ ID NO: 7600 - DNA, 19 bp, Artificial Sequence
  Description of Artificial Sequence: Chemically synthesized oligonucleotide
ggccatgtgtattcgctca

SEQ ID NO: 7601 - DNA, 19 bp, Artificial Sequence
  Description of Artificial Sequence: Chemically synthesized oligonucleotide
gagcgaatacacatggcct

SEQ ID NO: 7602 - DNA, 19 bp, Artificial Sequence
  Description of Artificial Sequence: Chemically synthesized oligonucleotide
aggccatgtgtattcgctc

SEQ ID NO: 7603 - DNA, 19 bp, Artificial Sequence
  Description of Artificial Sequence: Chemically synthesized oligonucleotide
agcgaatacacatggcctt

SEQ ID NO: 7604 - DNA, 19 bp, Artificial Sequence
  Description of Artificial Sequence: Chemically synthesized oligonucleotide
aaggccatgtgtattcgct

SEQ ID NO: 7605 - DNA, 19 bp, Artificial Sequence
  Description of Artificial Sequence: Chemically synthesized oligonucleotide
gcgaatacacatggccttc

SEQ ID NO: 7606 - DNA, 19 bp, Artificial Sequence
  Description of Artificial Sequence: Chemically synthesized oligonucleotide
gaaggccatgtgtattcgc

SEQ ID NO: 7607 - DNA, 19 bp, Artificial Sequence
  Description of Artificial Sequence: Chemically synthesized oligonucleotide
cgaatacacatggccttcg

SEQ ID NO: 7608 - DNA, 19 bp, Artificial Sequence
  Description of Artificial Sequence: Chemically synthesized oligonucleotide
cgaaggccatgtgtattcg

SEQ ID NO: 7609 - DNA, 19 bp, Artificial Sequence
  Description of Artificial Sequence: Chemically synthesized oligonucleotide
gaatacacatggccttcgc

SEQ ID NO: 7610 - DNA, 19 bp, Artificial Sequence
  Description of Artificial Sequence: Chemically synthesized oligonucleotide
gcgaaggccatgtgtattc

SEQ ID NO: 7611 - DNA, 19 bp, Artificial Sequence
  Description of Artificial Sequence: Chemically synthesized oligonucleotide
aatacacatggccttcgcc

SEQ ID NO: 7612 - DNA, 19 bp, Artificial Sequence
  Description of Artificial Sequence: Chemically synthesized oligonucleotide
ggcgaaggccatgtgtatt

SEQ ID NO: 7613 - DNA, 19 bp, Artificial Sequence
  Description of Artificial Sequence: Chemically synthesized oligonucleotide
atacacatggccttcgccc

SEQ ID NO: 7614 - DNA, 19 bp, Artificial Sequence
  Description of Artificial Sequence: Chemically synthesized oligonucleotide
gggcgaaggccatgtgtat

SEQ ID NO: 7615 - DNA, 19 bp, Artificial Sequence
  Description of Artificial Sequence: Chemically synthesized oligonucleotide
tacacatggccttcgcccc

SEQ ID NO: 7616 - DNA, 19 bp, Artificial Sequence
  Description of Artificial Sequence: Chemically synthesized oligonucleotide
ggggcgaaggccatgtgta

SEQ ID NO: 7617 - DNA, 19 bp, Artificial Sequence
  Description of Artificial Sequence: Chemically synthesized oligonucleotide
acacatggccttcgccccc

SEQ ID NO: 7618 - DNA, 19 bp, Artificial Sequence
  Description of Artificial Sequence: Chemically synthesized oligonucleotide
gggggcgaaggccatgtgt

SEQ ID NO: 7619 - DNA, 19 bp, Artificial Sequence
  Description of Artificial Sequence: Chemically synthesized oligonucleotide
cacatggccttcgcccccg

SEQ ID NO: 7620 - DNA, 19 bp, Artificial Sequence
  Description of Artificial Sequence: Chemically synthesized oligonucleotide
cgggggcgaaggccatgtg

SEQ ID NO: 7621 - DNA, 19 bp, Artificial Sequence
  Description of Artificial Sequence: Chemically synthesized oligonucleotide
acatggccttcgcccccgt

SEQ ID NO: 7622 - DNA, 19 bp, Artificial Sequence
  Description of Artificial Sequence: Chemically synthesized oligonucleotide
acgggggcgaaggccatgt

SEQ ID NO: 7623 - DNA, 19 bp, Artificial Sequence
  Description of Artificial Sequence: Chemically synthesized oligonucleotide
catggccttcgcccccgtc

SEQ ID NO: 7624 - DNA, 19 bp, Artificial Sequence
  Description of Artificial Sequence: Chemically synthesized oligonucleotide
gacgggggcgaaggccatg

SEQ ID NO: 7625 - DNA, 19 bp, Artificial Sequence
  Description of Artificial Sequence: Chemically synthesized oligonucleotide
atggccttcgcccccgtca

SEQ ID NO: 7626 - DNA, 19 bp, Artificial Sequence
  Description of Artificial Sequence: Chemically synthesized oligonucleotide
tgacgggggcgaaggccat

SEQ ID NO: 7627 - DNA, 19 bp, Artificial Sequence
  Description of Artificial Sequence: Chemically synthesized oligonucleotide
tggccttcgcccccgtcac

SEQ ID NO: 7628 - DNA, 19 bp, Artificial Sequence
  Description of Artificial Sequence: Chemically synthesized oligonucleotide
gtgacgggggcgaaggcca

SEQ ID NO: 7629 - DNA, 19 bp, Artificial Sequence
  Description of Artificial Sequence: Chemically synthesized oligonucleotide
ggccttcgcccccgtcact

SEQ ID NO: 7630 - DNA, 19 bp, Artificial Sequence
  Description of Artificial Sequence: Chemically synthesized oligonucleotide
agtgacgggggcgaaggcc

SEQ ID NO: 7631 - DNA, 19 bp, Artificial Sequence
  Description of Artificial Sequence: Chemically synthesized oligonucleotide
gccttcgcccccgtcactc

SEQ ID NO: 7632 - DNA, 19 bp, Artificial Sequence
  Description of Artificial Sequence: Chemically synthesized oligonucleotide
gagtgacgggggcgaaggc

SEQ ID NO: 7633 - DNA, 19 bp, Artificial Sequence
  Description of Artificial Sequence: Chemically synthesized oligonucleotide
ccttcgcccccgtcactcc

SEQ ID NO: 7634 - DNA, 19 bp, Artificial Sequence
  Description of Artificial Sequence: Chemically synthesized oligonucleotide
ggagtgacgggggcgaagg

SEQ ID NO: 7635 - DNA, 19 bp, Artificial Sequence
  Description of Artificial Sequence: Chemically synthesized oligonucleotide
cttcgcccccgtcactccg

SEQ ID NO: 7636 - DNA, 19 bp, Artificial Sequence
  Description of Artificial Sequence: Chemically synthesized oligonucleotide
cggagtgacgggggcgaag

SEQ ID NO: 7637 - DNA, 19 bp, Artificial Sequence
  Description of Artificial Sequence: Chemically synthesized oligonucleotide
ttcgcccccgtcactccgg

SEQ ID NO: 7638 - DNA, 19 bp, Artificial Sequence
  Description of Artificial Sequence: Chemically synthesized oligonucleotide
ccggagtgacgggggcgaa

SEQ ID NO: 7639 - DNA, 19 bp, Artificial Sequence
  Description of Artificial Sequence: Chemically synthesized oligonucleotide
tcgcccccgtcactccggc

SEQ ID NO: 7640 - DNA, 19 bp, Artificial Sequence
  Description of Artificial Sequence: Chemically synthesized oligonucleotide
gccggagtgacgggggcga

SEQ ID NO: 7641 - DNA, 19 bp, Artificial Sequence
  Description of Artificial Sequence: Chemically synthesized oligonucleotide
cgcccccgtcactccggcc

SEQ ID NO: 7642 - DNA, 19 bp, Artificial Sequence
  Description of Artificial Sequence: Chemically synthesized oligonucleotide
ggccggagtgacgggggcg

SEQ ID NO: 7643 - DNA, 19 bp, Artificial Sequence
  Description of Artificial Sequence: Chemically synthesized oligonucleotide
gcccccgtcactccggccc

SEQ ID NO: 7644 - DNA, 19 bp, Artificial Sequence
  Description of Artificial Sequence: Chemically synthesized oligonucleotide
gggccggagtgacgggggc

SEQ ID NO: 7645 - DNA, 19 bp, Artificial Sequence
  Description of Artificial Sequence: Chemically synthesized oligonucleotide
cccccgtcactccggccct

SEQ ID NO: 7646 - DNA, 19 bp, Artificial Sequence
  Description of Artificial Sequence: Chemically synthesized oligonucleotide
agggccggagtgacggggg

SEQ ID NO: 7647 - DNA, 19 bp, Artificial Sequence
  Description of Artificial Sequence: Chemically synthesized oligonucleotide
ccccgtcactccggccctg

SEQ ID NO: 7648 - DNA, 19 bp, Artificial Sequence
  Description of Artificial Sequence: Chemically synthesized oligonucleotide
cagggccggagtgacgggg

SEQ ID NO: 7649 - DNA, 19 bp, Artificial Sequence
  Description of Artificial Sequence: Chemically synthesized oligonucleotide
cccgtcactccggccctgc

SEQ ID NO: 7650 - DNA, 19 bp, Artificial Sequence
  Description of Artificial Sequence: Chemically synthesized oligonucleotide
gcagggccggagtgacggg

SEQ ID NO: 7651 - DNA, 19 bp, Artificial Sequence
  Description of Artificial Sequence: Chemically synthesized oligonucleotide
ccgtcactccggccctgcc

SEQ ID NO: 7652 - DNA, 19 bp, Artificial Sequence
  Description of Artificial Sequence: Chemically synthesized oligonucleotide
ggcagggccggagtgacgg

SEQ ID NO: 7653 - DNA, 19 bp, Artificial Sequence
  Description of Artificial Sequence: Chemically synthesized oligonucleotide
cgtcactccggccctgccc

SEQ ID NO: 7654 - DNA, 19 bp, Artificial Sequence
  Description of Artificial Sequence: Chemically synthesized oligonucleotide
gggcagggccggagtgacg

SEQ ID NO: 7655 - DNA, 19 bp, Artificial Sequence
  Description of Artificial Sequence: Chemically synthesized oligonucleotide
gtcactccggccctgccca

SEQ ID NO: 7656 - DNA, 19 bp, Artificial Sequence
  Description of Artificial Sequence: Chemically synthesized oligonucleotide
tgggcagggccggagtgac

SEQ ID NO: 7657 - DNA, 19 bp, Artificial Sequence
  Description of Artificial Sequence: Chemically synthesized oligonucleotide
tcactccggccctgcccag

SEQ ID NO: 7658 - DNA, 19 bp, Artificial Sequence
  Description of Artificial Sequence: Chemically synthesized oligonucleotide
ctgggcagggccggagtga

SEQ ID NO: 7659 - DNA, 19 bp, Artificial Sequence
  Description of Artificial Sequence: Chemically synthesized oligonucleotide
cactccggccctgcccagt

SEQ ID NO: 7660 - DNA, 19 bp, Artificial Sequence
  Description of Artificial Sequence: Chemically synthesized oligonucleotide
actgggcagggccggagtg

SEQ ID NO: 7661 - DNA, 19 bp, Artificial Sequence
  Description of Artificial Sequence: Chemically synthesized oligonucleotide
actccggccctgcccagtg

SEQ ID NO: 7662 - DNA, 19 bp, Artificial Sequence
  Description of Artificial Sequence: Chemically synthesized oligonucleotide
cactgggcagggccggagt

SEQ ID NO: 7663 - DNA, 19 bp, Artificial Sequence
  Description of Artificial Sequence: Chemically synthesized oligonucleotide
ctccggccctgcccagtga

SEQ ID NO: 7664 - DNA, 19 bp, Artificial Sequence
  Description of Artificial Sequence: Chemically synthesized oligonucleotide
tcactgggcagggccggag

SEQ ID NO: 7665 - DNA, 19 bp, Artificial Sequence
  Description of Artificial Sequence: Chemically synthesized oligonucleotide
tccggccctgcccagtgat

SEQ ID NO: 7666 - DNA, 19 bp, Artificial Sequence
  Description of Artificial Sequence: Chemically synthesized oligonucleotide
atcactgggcagggccgga

SEQ ID NO: 7667 - DNA, 19 bp, Artificial Sequence
  Description of Artificial Sequence: Chemically synthesized oligonucleotide
ccggccctgcccagtgatg

SEQ ID NO: 7668 - DNA, 19 bp, Artificial Sequence
  Description of Artificial Sequence: Chemically synthesized oligonucleotide
catcactgggcagggccgg

SEQ ID NO: 7669 - DNA, 19 bp, Artificial Sequence
  Description of Artificial Sequence: Chemically synthesized oligonucleotide
cggccctgcccagtgatga

SEQ ID NO: 7670 - DNA, 19 bp, Artificial Sequence
  Description of Artificial Sequence: Chemically synthesized oligonucleotide
tcatcactgggcagggccg

SEQ ID NO: 7671 - DNA, 19 bp, Artificial Sequence
  Description of Artificial Sequence: Chemically synthesized oligonucleotide
ggccctgcccagtgatgac

SEQ ID NO: 7672 - DNA, 19 bp, Artificial Sequence
  Description of Artificial Sequence: Chemically synthesized oligonucleotide
gtcatcactgggcagggcc

SEQ ID NO: 7673 - DNA, 19 bp, Artificial Sequence
  Description of Artificial Sequence: Chemically synthesized oligonucleotide
gccctgcccagtgatgacc

SEQ ID NO: 7674 - DNA, 19 bp, Artificial Sequence
  Description of Artificial Sequence: Chemically synthesized oligonucleotide
ggtcatcactgggcagggc

SEQ ID NO: 7675 - DNA, 19 bp, Artificial Sequence
  Description of Artificial Sequence: Chemically synthesized oligonucleotide
ccctgcccagtgatgaccg

SEQ ID NO: 7676 - DNA, 19 bp, Artificial Sequence
  Description of Artificial Sequence: Chemically synthesized oligonucleotide
cggtcatcactgggcaggg

SEQ ID NO: 7677 - DNA, 19 bp, Artificial Sequence
  Description of Artificial Sequence: Chemically synthesized oligonucleotide
cctgcccagtgatgaccgc

SEQ ID NO: 7678 - DNA, 19 bp, Artificial Sequence
  Description of Artificial Sequence: Chemically synthesized oligonucleotide
gcggtcatcactgggcagg

SEQ ID NO: 7679 - DNA, 19 bp, Artificial Sequence
  Description of Artificial Sequence: Chemically synthesized oligonucleotide
ctgcccagtgatgaccgca

SEQ ID NO: 7680 - DNA, 19 bp, Artificial Sequence
  Description of Artificial Sequence: Chemically synthesized oligonucleotide
tgcggtcatcactgggcag

SEQ ID NO: 7681 - DNA, 19 bp, Artificial Sequence
  Description of Artificial Sequence: Chemically synthesized oligonucleotide
tgcccagtgatgaccgcat

SEQ ID NO: 7682 - DNA, 19 bp, Artificial Sequence
  Description of Artificial Sequence: Chemically synthesized oligonucleotide
atgcggtcatcactgggca

SEQ ID NO: 7683 - DNA, 19 bp, Artificial Sequence
  Description of Artificial Sequence: Chemically synthesized oligonucleotide
gcccagtgatgaccgcatc

SEQ ID NO: 7684 - DNA, 19 bp, Artificial Sequence
  Description of Artificial Sequence: Chemically synthesized oligonucleotide
gatgcggtcatcactgggc

SEQ ID NO: 7685 - DNA, 19 bp, Artificial Sequence
  Description of Artificial Sequence: Chemically synthesized oligonucleotide
cccagtgatgaccgcatca

SEQ ID NO: 7686 - DNA, 19 bp, Artificial Sequence
  Description of Artificial Sequence: Chemically synthesized oligonucleotide
tgatgcggtcatcactggg

SEQ ID NO: 7687 - DNA, 19 bp, Artificial Sequence
  Description of Artificial Sequence: Chemically synthesized oligonucleotide
ccagtgatgaccgcatcac

SEQ ID NO: 7688 - DNA, 19 bp, Artificial Sequence
  Description of Artificial Sequence: Chemically synthesized oligonucleotide
gtgatgcggtcatcactgg

SEQ ID NO: 7689 - DNA, 19 bp, Artificial Sequence
  Description of Artificial Sequence: Chemically synthesized oligonucleotide
cagtgatgaccgcatcacc

SEQ ID NO: 7690 - DNA, 19 bp, Artificial Sequence
  Description of Artificial Sequence: Chemically synthesized oligonucleotide
ggtgatgcggtcatcactg

SEQ ID NO: 7691 - DNA, 19 bp, Artificial Sequence
  Description of Artificial Sequence: Chemically synthesized oligonucleotide
agtgatgaccgcatcacca

SEQ ID NO: 7692 - DNA, 19 bp, Artificial Sequence
  Description of Artificial Sequence: Chemically synthesized oligonucleotide
tggtgatgcggtcatcact

SEQ ID NO: 7693 - DNA, 19 bp, Artificial Sequence
  Description of Artificial Sequence: Chemically synthesized oligonucleotide
gtgatgaccgcatcaccaa

SEQ ID NO: 7694 - DNA, 19 bp, Artificial Sequence
  Description of Artificial Sequence: Chemically synthesized oligonucleotide
ttggtgatgcggtcatcac

SEQ ID NO: 7695 - DNA, 19 bp, Artificial Sequence
  Description of Artificial Sequence: Chemically synthesized oligonucleotide
tgatgaccgcatcaccaac

SEQ ID NO: 7696 - DNA, 19 bp, Artificial Sequence
  Description of Artificial Sequence: Chemically synthesized oligonucleotide
gttggtgatgcggtcatca

SEQ ID NO: 7697 - DNA, 19 bp, Artificial Sequence
  Description of Artificial Sequence: Chemically synthesized oligonucleotide
gatgaccgcatcaccaaca

SEQ ID NO: 7698 - DNA, 19 bp, Artificial Sequence
  Description of Artificial Sequence: Chemically synthesized oligonucleotide
tgttggtgatgcggtcatc

SEQ ID NO: 7699 - DNA, 19 bp, Artificial Sequence
  Description of Artificial Sequence: Chemically synthesized oligonucleotide
atgaccgcatcaccaacat

SEQ ID NO: 7700 - DNA, 19 bp, Artificial Sequence
  Description of Artificial Sequence: Chemically synthesized oligonucleotide
atgttggtgatgcggtcat

SEQ ID NO: 7701 - DNA, 19 bp, Artificial Sequence
  Description of Artificial Sequence: Chemically synthesized oligonucleotide
tgaccgcatcaccaacatc

SEQ ID NO: 7702 - DNA, 19 bp, Artificial Sequence
  Description of Artificial Sequence: Chemically synthesized oligonucleotide
gatgttggtgatgcggtca

SEQ ID NO: 7703 - DNA, 19 bp, Artificial Sequence
  Description of Artificial Sequence: Chemically synthesized oligonucleotide
gaccgcatcaccaacatcc

SEQ ID NO: 7704 - DNA, 19 bp, Artificial Sequence
  Description of Artificial Sequence: Chemically synthesized oligonucleotide
ggatgttggtgatgcggtc

SEQ ID NO: 7705 - DNA, 19 bp, Artificial Sequence
  Description of Artificial Sequence: Chemically synthesized oligonucleotide
accgcatcaccaacatcct

SEQ ID NO: 7706 - DNA, 19 bp, Artificial Sequence
  Description of Artificial Sequence: Chemically synthesized oligonucleotide
aggatgttggtgatgcggt

SEQ ID NO: 7707 - DNA, 19 bp, Artificial Sequence
  Description of Artificial Sequence: Chemically synthesized oligonucleotide
ccgcatcaccaacatcctg

SEQ ID NO: 7708 - DNA, 19 bp, Artificial Sequence
  Description of Artificial Sequence: Chemically synthesized oligonucleotide
caggatgttggtgatgcgg

SEQ ID NO: 7709 - DNA, 19 bp, Artificial Sequence
  Description of Artificial Sequence: Chemically synthesized oligonucleotide
cgcatcaccaacatcctgg

SEQ ID NO: 7710 - DNA, 19 bp, Artificial Sequence
  Description of Artificial Sequence: Chemically synthesized oligonucleotide
ccaggatgttggtgatgcg

SEQ ID NO: 7711 - DNA, 19 bp, Artificial Sequence
  Description of Artificial Sequence: Chemically synthesized oligonucleotide
gcatcaccaacatcctgga

SEQ ID NO: 7712 - DNA, 19 bp, Artificial Sequence
  Description of Artificial Sequence: Chemically synthesized oligonucleotide
tccaggatgttggtgatgc

SEQ ID NO: 7713 - DNA, 19 bp, Artificial Sequence
  Description of Artificial Sequence: Chemically synthesized oligonucleotide
catcaccaacatcctggac

SEQ ID NO: 7714 - DNA, 19 bp, Artificial Sequence
  Description of Artificial Sequence: Chemically synthesized oligonucleotide
gtccaggatgttggtgatg

SEQ ID NO: 7715 - DNA, 19 bp, Artificial Sequence
  Description of Artificial Sequence: Chemically synthesized oligonucleotide
atcaccaacatcctggaca

SEQ ID NO: 7716 - DNA, 19 bp, Artificial Sequence
  Description of Artificial Sequence: Chemically synthesized oligonucleotide
tgtccaggatgttggtgat

SEQ ID NO: 7717 - DNA, 19 bp, Artificial Sequence
  Description of Artificial Sequence: Chemically synthesized oligonucleotide
tcaccaacatcctggacag

SEQ ID NO: 7718 - DNA, 19 bp, Artificial Sequence
  Description of Artificial Sequence: Chemically synthesized oligonucleotide
ctgtccaggatgttggtga

SEQ ID NO: 7719 - DNA, 19 bp, Artificial Sequence
  Description of Artificial Sequence: Chemically synthesized oligonucleotide
caccaacatcctggacagc

SEQ ID NO: 7720 - DNA, 19 bp, Artificial Sequence
  Description of Artificial Sequence: Chemically synthesized oligonucleotide
gctgtccaggatgttggtg

SEQ ID NO: 7721 - DNA, 19 bp, Artificial Sequence
  Description of Artificial Sequence: Chemically synthesized oligonucleotide
accaacatcctggacagca

SEQ ID NO: 7722 - DNA, 19 bp, Artificial Sequence
  Description of Artificial Sequence: Chemically synthesized oligonucleotide
tgctgtccaggatgttggt

SEQ ID NO: 7723 - DNA, 19 bp, Artificial Sequence
  Description of Artificial Sequence: Chemically synthesized oligonucleotide
ccaacatcctggacagcat

SEQ ID NO: 7724 - DNA, 19 bp, Artificial Sequence
  Description of Artificial Sequence: Chemically synthesized oligonucleotide
atgctgtccaggatgttgg

SEQ ID NO: 7725 - DNA, 19 bp, Artificial Sequence
  Description of Artificial Sequence: Chemically synthesized oligonucleotide
caacatcctggacagcatt

SEQ ID NO: 7726 - DNA, 19 bp, Artificial Sequence
  Description of Artificial Sequence: Chemically synthesized oligonucleotide
aatgctgtccaggatgttg

SEQ ID NO: 7727 - DNA, 19 bp, Artificial Sequence
  Description of Artificial Sequence: Chemically synthesized oligonucleotide
aacatcctggacagcatta

SEQ ID NO: 7728 - DNA, 19 bp, Artificial Sequence
  Description of Artificial Sequence: Chemically synthesized oligonucleotide
taatgctgtccaggatgtt

SEQ ID NO: 7729 - DNA, 19 bp, Artificial Sequence
  Description of Artificial Sequence: Chemically synthesized oligonucleotide
acatcctggacagcattat

SEQ ID NO: 7730 - DNA, 19 bp, Artificial Sequence
  Description of Artificial Sequence: Chemically synthesized oligonucleotide
ataatgctgtccaggatgt

SEQ ID NO: 7731 - DNA, 19 bp, Artificial Sequence
  Description of Artificial Sequence: Chemically synthesized oligonucleotide
catcctggacagcattatc

SEQ ID NO: 7732 - DNA, 19 bp, Artificial Sequence
  Description of Artificial Sequence: Chemically synthesized oligonucleotide
gataatgctgtccaggatg

SEQ ID NO: 7733 - DNA, 19 bp, Artificial Sequence
  Description of Artificial Sequence: Chemically synthesized oligonucleotide
atcctggacagcattatcg

SEQ ID NO: 7734 - DNA, 19 bp, Artificial Sequence
  Description of Artificial Sequence: Chemically synthesized oligonucleotide
cgataatgctgtccaggat

SEQ ID NO: 7735 - DNA, 19 bp, Artificial Sequence
  Description of Artificial Sequence: Chemically synthesized oligonucleotide
tcctggacagcattatcgc

SEQ ID NO: 7736 - DNA, 19 bp, Artificial Sequence
  Description of Artificial Sequence: Chemically synthesized oligonucleotide
gcgataatgctgtccagga

SEQ ID NO: 7737 - DNA, 19 bp, Artificial Sequence
  Description of Artificial Sequence: Chemically synthesized oligonucleotide
cctggacagcattatcgca

SEQ ID NO: 7738 - DNA, 19 bp, Artificial Sequence
  Description of Artificial Sequence: Chemically synthesized oligonucleotide
tgcgataatgctgtccagg

SEQ ID NO: 7739 - DNA, 19 bp, Artificial Sequence
  Description of Artificial Sequence: Chemically synthesized oligonucleotide
ctggacagcattatcgcac

SEQ ID NO: 7740 - DNA, 19 bp, Artificial Sequence
  Description of Artificial Sequence: Chemically synthesized oligonucleotide
gtgcgataatgctgtccag

SEQ ID NO: 7741 - DNA, 19 bp, Artificial Sequence
  Description of Artificial Sequence: Chemically synthesized oligonucleotide
tggacagcattatcgcaca

SEQ ID NO: 7742 - DNA, 19 bp, Artificial Sequence
  Description of Artificial Sequence: Chemically synthesized oligonucleotide
tgtgcgataatgctgtcca

SEQ ID NO: 7743 - DNA, 19 bp, Artificial Sequence
  Description of Artificial Sequence: Chemically synthesized oligonucleotide
ggacagcattatcgcacag

SEQ ID NO: 7744 - DNA, 19 bp, Artificial Sequence
  Description of Artificial Sequence: Chemically synthesized oligonucleotide
ctgtgcgataatgctgtcc

SEQ ID NO: 7745 - DNA, 19 bp, Artificial Sequence
  Description of Artificial Sequence: Chemically synthesized oligonucleotide
gacagcattatcgcacagg

SEQ ID NO: 7746 - DNA, 19 bp, Artificial Sequence
  Description of Artificial Sequence: Chemically synthesized oligonucleotide
cctgtgcgataatgctgtc

SEQ ID NO: 7747 - DNA, 19 bp, Artificial Sequence
  Description of Artificial Sequence: Chemically synthesized oligonucleotide
acagcattatcgcacaggt

SEQ ID NO: 7748 - DNA, 19 bp, Artificial Sequence
  Description of Artificial Sequence: Chemically synthesized oligonucleotide
acctgtgcgataatgctgt

SEQ ID NO: 7749 - DNA, 19 bp, Artificial Sequence
  Description of Artificial Sequence: Chemically synthesized oligonucleotide
cagcattatcgcacaggtg

SEQ ID NO: 7750 - DNA, 19 bp, Artificial Sequence
  Description of Artificial Sequence: Chemically synthesized oligonucleotide
cacctgtgcgataatgctg

SEQ ID NO: 7751 - DNA, 19 bp, Artificial Sequence
  Description of Artificial Sequence: Chemically synthesized oligonucleotide
agcattatcgcacaggtgg

SEQ ID NO: 7752 - DNA, 19 bp, Artificial Sequence
  Description of Artificial Sequence: Chemically synthesized oligonucleotide
ccacctgtgcgataatgct

SEQ ID NO: 7753 - DNA, 19 bp, Artificial Sequence
  Description of Artificial Sequence: Chemically synthesized oligonucleotide
gcattatcgcacaggtggt

SEQ ID NO: 7754 - DNA, 19 bp, Artificial Sequence
  Description of Artificial Sequence: Chemically synthesized oligonucleotide
accacctgtgcgataatgc

SEQ ID NO: 7755 - DNA, 19 bp, Artificial Sequence
  Description of Artificial Sequence: Chemically synthesized oligonucleotide
cattatcgcacaggtggtg

SEQ ID NO: 7756 - DNA, 19 bp, Artificial Sequence
  Description of Artificial Sequence: Chemically synthesized oligonucleotide
caccacctgtgcgataatg

SEQ ID NO: 7757 - DNA, 19 bp, Artificial Sequence
  Description of Artificial Sequence: Chemically synthesized oligonucleotide
attatcgcacaggtggtgg

SEQ ID NO: 7758 - DNA, 19 bp, Artificial Sequence
  Description of Artificial Sequence: Chemically synthesized oligonucleotide
ccaccacctgtgcgataat

SEQ ID NO: 7759 - DNA, 19 bp, Artificial Sequence
  Description of Artificial Sequence: Chemically synthesized oligonucleotide
ttatcgcacaggtggtgga

SEQ ID NO: 7760 - DNA, 19 bp, Artificial Sequence
  Description of Artificial Sequence: Chemically synthesized oligonucleotide
tccaccacctgtgcgataa

SEQ ID NO: 7761 - DNA, 19 bp, Artificial Sequence
  Description of Artificial Sequence: Chemically synthesized oligonucleotide
tatcgcacaggtggtggaa

SEQ ID NO: 7762 - DNA, 19 bp, Artificial Sequence
  Description of Artificial Sequence: Chemically synthesized oligonucleotide
ttccaccacctgtgcgata

SEQ ID NO: 7763 - DNA, 19 bp, Artificial Sequence
  Description of Artificial Sequence: Chemically synthesized oligonucleotide
atcgcacaggtggtggaac

SEQ ID NO: 7764 - DNA, 19 bp, Artificial Sequence
  Description of Artificial Sequence: Chemically synthesized oligonucleotide
gttccaccacctgtgcgat

SEQ ID NO: 7765 - DNA, 19 bp, Artificial Sequence
  Description of Artificial Sequence: Chemically synthesized oligonucleotide
tcgcacaggtggtggaacg

SEQ ID NO: 7766 - DNA, 19 bp, Artificial Sequence
  Description of Artificial Sequence: Chemically synthesized oligonucleotide
cgttccaccacctgtgcga

SEQ ID NO: 7767 - DNA, 19 bp, Artificial Sequence
  Description of Artificial Sequence: Chemically synthesized oligonucleotide
cgcacaggtggtggaacgg

SEQ ID NO: 7768 - DNA, 19 bp, Artificial Sequence
  Description of Artificial Sequence: Chemically synthesized oligonucleotide
ccgttccaccacctgtgcg

SEQ ID NO: 7769 - DNA, 19 bp, Artificial Sequence
  Description of Artificial Sequence: Chemically synthesized oligonucleotide
gcacaggtggtggaacgga

SEQ ID NO: 7770 - DNA, 19 bp, Artificial Sequence
  Description of Artificial Sequence: Chemically synthesized oligonucleotide
tccgttccaccacctgtgc

SEQ ID NO: 7771 - DNA, 19 bp, Artificial Sequence
  Description of Artificial Sequence: Chemically synthesized oligonucleotide
cacaggtggtggaacggaa

SEQ ID NO: 7772 - DNA, 19 bp, Artificial Sequence
  Description of Artificial Sequence: Chemically synthesized oligonucleotide
ttccgttccaccacctgtg

SEQ ID NO: 7773 - DNA, 19 bp, Artificial Sequence
  Description of Artificial Sequence: Chemically synthesized oligonucleotide
acaggtggtggaacggaag

SEQ ID NO: 7774 - DNA, 19 bp, Artificial Sequence
  Description of Artificial Sequence: Chemically synthesized oligonucleotide
cttccgttccaccacctgt

SEQ ID NO: 7775 - DNA, 19 bp, Artificial Sequence
  Description of Artificial Sequence: Chemically synthesized oligonucleotide
caggtggtggaacggaaga

SEQ ID NO: 7776 - DNA, 19 bp, Artificial Sequence
  Description of Artificial Sequence: Chemically synthesized oligonucleotide
tcttccgttccaccacctg

SEQ ID NO: 7777 - DNA, 19 bp, Artificial Sequence
  Description of Artificial Sequence: Chemically synthesized oligonucleotide
aggtggtggaacggaagat

SEQ ID NO: 7778 - DNA, 19 bp, Artificial Sequence
  Description of Artificial Sequence: Chemically synthesized oligonucleotide
atcttccgttccaccacct

SEQ ID NO: 7779 - DNA, 19 bp, Artificial Sequence
  Description of Artificial Sequence: Chemically synthesized oligonucleotide
ggtggtggaacggaagatc

SEQ ID NO: 7780 - DNA, 19 bp, Artificial Sequence
  Description of Artificial Sequence: Chemically synthesized oligonucleotide
gatcttccgttccaccacc

SEQ ID NO: 7781 - DNA, 19 bp, Artificial Sequence
  Description of Artificial Sequence: Chemically synthesized oligonucleotide
gtggtggaacggaagatcc

SEQ ID NO: 7782 - DNA, 19 bp, Artificial Sequence
  Description of Artificial Sequence: Chemically synthesized oligonucleotide
ggatcttccgttccaccac

SEQ ID NO: 7783 - DNA, 19 bp, Artificial Sequence
  Description of Artificial Sequence: Chemically synthesized oligonucleotide
tggtggaacggaagatcca

SEQ ID NO: 7784 - DNA, 19 bp, Artificial Sequence
  Description of Artificial Sequence: Chemically synthesized oligonucleotide
tggatcttccgttccacca

SEQ ID NO: 7785 - DNA, 19 bp, Artificial Sequence
  Description of Artificial Sequence: Chemically synthesized oligonucleotide
ggtggaacggaagatccag

SEQ ID NO: 7786 - DNA, 19 bp, Artificial Sequence
  Description of Artificial Sequence: Chemically synthesized oligonucleotide
ctggatcttccgttccacc

SEQ ID NO: 7787 - DNA, 19 bp, Artificial Sequence
  Description of Artificial Sequence: Chemically synthesized oligonucleotide
gtggaacggaagatccagg

SEQ ID NO: 7788 - DNA, 19 bp, Artificial Sequence
  Description of Artificial Sequence: Chemically synthesized oligonucleotide
cctggatcttccgttccac

SEQ ID NO: 7789 - DNA, 19 bp, Artificial Sequence
  Description of Artificial Sequence: Chemically synthesized oligonucleotide
tggaacggaagatccagga

SEQ ID NO: 7790 - DNA, 19 bp, Artificial Sequence
  Description of Artificial Sequence: Chemically synthesized oligonucleotide
tcctggatcttccgttcca

SEQ ID NO: 7791 - DNA, 19 bp, Artificial Sequence
  Description of Artificial Sequence: Chemically synthesized oligonucleotide
ggaacggaagatccaggag

SEQ ID NO: 7792 - DNA, 19 bp, Artificial Sequence
  Description of Artificial Sequence: Chemically synthesized oligonucleotide
ctcctggatcttccgttcc

SEQ ID NO: 7793 - DNA, 19 bp, Artificial Sequence
  Description of Artificial Sequence: Chemically synthesized oligonucleotide
gaacggaagatccaggaga

SEQ ID NO: 7794 - DNA, 19 bp, Artificial Sequence
  Description of Artificial Sequence: Chemically synthesized oligonucleotide
tctcctggatcttccgttc

SEQ ID NO: 7795 - DNA, 19 bp, Artificial Sequence
  Description of Artificial Sequence: Chemically synthesized oligonucleotide
aacggaagatccaggagaa

SEQ ID NO: 7796 - DNA, 19 bp, Artificial Sequence
  Description of Artificial Sequence: Chemically synthesized oligonucleotide
ttctcctggatcttccgtt

SEQ ID NO: 7797 - DNA, 19 bp, Artificial Sequence
  Description of Artificial Sequence: Chemically synthesized oligonucleotide
acggaagatccaggagaaa

SEQ ID NO: 7798 - DNA, 19 bp, Artificial Sequence
  Description of Artificial Sequence: Chemically synthesized oligonucleotide
tttctcctggatcttccgt

SEQ ID NO: 7799 - DNA, 19 bp, Artificial Sequence
  Description of Artificial Sequence: Chemically synthesized oligonucleotide
cggaagatccaggagaaag

SEQ ID NO: 7800 - DNA, 19 bp, Artificial Sequence
  Description of Artificial Sequence: Chemically synthesized oligonucleotide
ctttctcctggatcttccg

SEQ ID NO: 7801 - DNA, 19 bp, Artificial Sequence
  Description of Artificial Sequence: Chemically synthesized oligonucleotide
ggaagatccaggagaaagc

SEQ ID NO: 7802 - DNA, 19 bp, Artificial Sequence
  Description of Artificial Sequence: Chemically synthesized oligonucleotide
gctttctcctggatcttcc

SEQ ID NO: 7803 - DNA, 19 bp, Artificial Sequence
  Description of Artificial Sequence: Chemically synthesized oligonucleotide
gaagatccaggagaaagcc

SEQ ID NO: 7804 - DNA, 19 bp, Artificial Sequence
  Description of Artificial Sequence: Chemically synthesized oligonucleotide
ggctttctcctggatcttc

SEQ ID NO: 7805 - DNA, 19 bp, Artificial Sequence
  Description of Artificial Sequence: Chemically synthesized oligonucleotide
aagatccaggagaaagccc

SEQ ID NO: 7806 - DNA, 19 bp, Artificial Sequence
  Description of Artificial Sequence: Chemically synthesized oligonucleotide
gggctttctcctggatctt

SEQ ID NO: 7807 - DNA, 19 bp, Artificial Sequence
  Description of Artificial Sequence: Chemically synthesized oligonucleotide
agatccaggagaaagccct

SEQ ID NO: 7808 - DNA, 19 bp, Artificial Sequence
  Description of Artificial Sequence: Chemically synthesized oligonucleotide
agggctttctcctggatct

SEQ ID NO: 7809 - DNA, 19 bp, Artificial Sequence
  Description of Artificial Sequence: Chemically synthesized oligonucleotide
gatccaggagaaagccctg

SEQ ID NO: 7810 - DNA, 19 bp, Artificial Sequence
  Description of Artificial Sequence: Chemically synthesized oligonucleotide
cagggctttctcctggatc

SEQ ID NO: 7811 - DNA, 19 bp, Artificial Sequence
  Description of Artificial Sequence: Chemically synthesized oligonucleotide
atccaggagaaagccctgg

SEQ ID NO: 7812 - DNA, 19 bp, Artificial Sequence
  Description of Artificial Sequence: Chemically synthesized oligonucleotide
ccagggctttctcctggat

SEQ ID NO: 7813 - DNA, 19 bp, Artificial Sequence
  Description of Artificial Sequence: Chemically synthesized oligonucleotide
tccaggagaaagccctggg

SEQ ID NO: 7814 - DNA, 19 bp, Artificial Sequence
  Description of Artificial Sequence: Chemically synthesized oligonucleotide
cccagggctttctcctgga

SEQ ID NO: 7815 - DNA, 19 bp, Artificial Sequence
  Description of Artificial Sequence: Chemically synthesized oligonucleotide
ccaggagaaagccctgggg

SEQ ID NO: 7816 - DNA, 19 bp, Artificial Sequence
  Description of Artificial Sequence: Chemically synthesized oligonucleotide
ccccagggctttctcctgg

SEQ ID NO: 7817 - DNA, 19 bp, Artificial Sequence
  Description of Artificial Sequence: Chemically synthesized oligonucleotide
caggagaaagccctggggc

SEQ ID NO: 7818 - DNA, 19 bp, Artificial Sequence
  Description of Artificial Sequence: Chemically synthesized oligonucleotide
gccccagggctttctcctg

SEQ ID NO: 7819 - DNA, 19 bp, Artificial Sequence
  Description of Artificial Sequence: Chemically synthesized oligonucleotide
aggagaaagccctggggcc

SEQ ID NO: 7820 - DNA, 19 bp, Artificial Sequence
  Description of Artificial Sequence: Chemically synthesized oligonucleotide
ggccccagggctttctcct

SEQ ID NO: 7821 - DNA, 19 bp, Artificial Sequence
  Description of Artificial Sequence: Chemically synthesized oligonucleotide
ggagaaagccctggggccg

SEQ ID NO: 7822 - DNA, 19 bp, Artificial Sequence
  Description of Artificial Sequence: Chemically synthesized oligonucleotide
cggccccagggctttctcc

SEQ ID NO: 7823 - DNA, 19 bp, Artificial Sequence
  Description of Artificial Sequence: Chemically synthesized oligonucleotide
gagaaagccctggggccgg

SEQ ID NO: 7824 - DNA, 19 bp, Artificial Sequence
  Description of Artificial Sequence: Chemically synthesized oligonucleotide
ccggccccagggctttctc

SEQ ID NO: 7825 - DNA, 19 bp, Artificial Sequence
  Description of Artificial Sequence: Chemically synthesized oligonucleotide
agaaagccctggggccggg

SEQ ID NO: 7826 - DNA, 19 bp, Artificial Sequence
  Description of Artificial Sequence: Chemically synthesized oligonucleotide
cccggccccagggctttct

SEQ ID NO: 7827 - DNA, 19 bp, Artificial Sequence
  Description of Artificial Sequence: Chemically synthesized oligonucleotide
gaaagccctggggccgggg

SEQ ID NO: 7828 - DNA, 19 bp, Artificial Sequence
  Description of Artificial Sequence: Chemically synthesized oligonucleotide
ccccggccccagggctttc

SEQ ID NO: 7829 - DNA, 19 bp, Artificial Sequence
  Description of Artificial Sequence: Chemically synthesized oligonucleotide
aaagccctggggccggggc

SEQ ID NO: 7830 - DNA, 19 bp, Artificial Sequence
  Description of Artificial Sequence: Chemically synthesized oligonucleotide
gccccggccccagggcttt

SEQ ID NO: 7831 - DNA, 19 bp, Artificial Sequence
  Description of Artificial Sequence: Chemically synthesized oligonucleotide
aagccctggggccggggct

SEQ ID NO: 7832 - DNA, 19 bp, Artificial Sequence
  Description of Artificial Sequence: Chemically synthesized oligonucleotide
agccccggccccagggctt

SEQ ID NO: 7833 - DNA, 19 bp, Artificial Sequence
  Description of Artificial Sequence: Chemically synthesized oligonucleotide
agccctggggccggggctt

SEQ ID NO: 7834 - DNA, 19 bp, Artificial Sequence
  Description of Artificial Sequence: Chemically synthesized oligonucleotide
aagccccggccccagggct

SEQ ID NO: 7835 - DNA, 19 bp, Artificial Sequence
  Description of Artificial Sequence: Chemically synthesized oligonucleotide
gccctggggccggggcttc

SEQ ID NO: 7836 - DNA, 19 bp, Artificial Sequence
  Description of Artificial Sequence: Chemically synthesized oligonucleotide
gaagccccggccccagggc

SEQ ID NO: 7837 - DNA, 19 bp, Artificial Sequence
  Description of Artificial Sequence: Chemically synthesized oligonucleotide
ccctggggccggggcttcg

SEQ ID NO: 7838 - DNA, 19 bp, Artificial Sequence
  Description of Artificial Sequence: Chemically synthesized oligonucleotide
cgaagccccggccccaggg

SEQ ID NO: 7839 - DNA, 19 bp, Artificial Sequence
  Description of Artificial Sequence: Chemically synthesized oligonucleotide
cctggggccggggcttcga

SEQ ID NO: 7840 - DNA, 19 bp, Artificial Sequence
  Description of Artificial Sequence: Chemically synthesized oligonucleotide
tcgaagccccggccccagg

SEQ ID NO: 7841 - DNA, 19 bp, Artificial Sequence
  Description of Artificial Sequence: Chemically synthesized oligonucleotide
ctggggccggggcttcgag

SEQ ID NO: 7842 - DNA, 19 bp, Artificial Sequence
  Description of Artificial Sequence: Chemically synthesized oligonucleotide
ctcgaagccccggccccag

SEQ ID NO: 7843 - DNA, 19 bp, Artificial Sequence
  Description of Artificial Sequence: Chemically synthesized oligonucleotide
tggggccggggcttcgagc

SEQ ID NO: 7844 - DNA, 19 bp, Artificial Sequence
  Description of Artificial Sequence: Chemically synthesized oligonucleotide
gctcgaagccccggcccca

SEQ ID NO: 7845 - DNA, 19 bp, Artificial Sequence
  Description of Artificial Sequence: Chemically synthesized oligonucleotide
ggggccggggcttcgagct

SEQ ID NO: 7846 - DNA, 19 bp, Artificial Sequence
  Description of Artificial Sequence: Chemically synthesized oligonucleotide
agctcgaagccccggcccc

SEQ ID NO: 7847 - DNA, 19 bp, Artificial Sequence
  Description of Artificial Sequence: Chemically synthesized oligonucleotide
gggccggggcttcgagctg

SEQ ID NO: 7848 - DNA, 19 bp, Artificial Sequence
  Description of Artificial Sequence: Chemically synthesized oligonucleotide
cagctcgaagccccggccc

SEQ ID NO: 7849 - DNA, 19 bp, Artificial Sequence
  Description of Artificial Sequence: Chemically synthesized oligonucleotide
ggccggggcttcgagctgg

SEQ ID NO: 7850 - DNA, 19 bp, Artificial Sequence
  Description of Artificial Sequence: Chemically synthesized oligonucleotide
ccagctcgaagccccggcc

SEQ ID NO: 7851 - DNA, 19 bp, Artificial Sequence
  Description of Artificial Sequence: Chemically synthesized oligonucleotide
gccggggcttcgagctggc

SEQ ID NO: 7852 - DNA, 19 bp, Artificial Sequence
  Description of Artificial Sequence: Chemically synthesized oligonucleotide
gccagctcgaagccccggc

SEQ ID NO: 7853 - DNA, 19 bp, Artificial Sequence
  Description of Artificial Sequence: Chemically synthesized oligonucleotide
ccggggcttcgagctggcc

SEQ ID NO: 7854 - DNA, 19 bp, Artificial Sequence
  Description of Artificial Sequence: Chemically synthesized oligonucleotide
ggccagctcgaagccccgg

SEQ ID NO: 7855 - DNA, 19 bp, Artificial Sequence
  Description of Artificial Sequence: Chemically synthesized oligonucleotide
cggggcttcgagctggccc

SEQ ID NO: 7856 - DNA, 19 bp, Artificial Sequence
  Description of Artificial Sequence: Chemically synthesized oligonucleotide
gggccagctcgaagccccg

SEQ ID NO: 7857 - DNA, 19 bp, Artificial Sequence
  Description of Artificial Sequence: Chemically synthesized oligonucleotide
ggggcttcgagctggcccg

SEQ ID NO: 7858 - DNA, 19 bp, Artificial Sequence
  Description of Artificial Sequence: Chemically synthesized oligonucleotide
cgggccagctcgaagcccc

SEQ ID NO: 7859 - DNA, 19 bp, Artificial Sequence
  Description of Artificial Sequence: Chemically synthesized oligonucleotide
gggcttcgagctggcccgg

SEQ ID NO: 7860 - DNA, 19 bp, Artificial Sequence
  Description of Artificial Sequence: Chemically synthesized oligonucleotide
ccgggccagctcgaagccc

SEQ ID NO: 7861 - DNA, 19 bp, Artificial Sequence
  Description of Artificial Sequence: Chemically synthesized oligonucleotide
ggcttcgagctggcccggg

SEQ ID NO: 7862 - DNA, 19 bp, Artificial Sequence
  Description of Artificial Sequence: Chemically synthesized oligonucleotide
cccgggccagctcgaagcc

SEQ ID NO: 7863 - DNA, 19 bp, Artificial Sequence
  Description of Artificial Sequence: Chemically synthesized oligonucleotide
gcttcgagctggcccgggt

SEQ ID NO: 7864 - DNA, 19 bp, Artificial Sequence
  Description of Artificial Sequence: Chemically synthesized oligonucleotide
acccgggccagctcgaagc

SEQ ID NO: 7865 - DNA, 19 bp, Artificial Sequence
  Description of Artificial Sequence: Chemically synthesized oligonucleotide
cttcgagctggcccgggtc

SEQ ID NO: 7866 - DNA, 19 bp, Artificial Sequence
  Description of Artificial Sequence: Chemically synthesized oligonucleotide
gacccgggccagctcgaag

SEQ ID NO: 7867 - DNA, 19 bp, Artificial Sequence
  Description of Artificial Sequence: Chemically synthesized oligonucleotide
ttcgagctggcccgggtct

SEQ ID NO: 7868 - DNA, 19 bp, Artificial Sequence
  Description of Artificial Sequence: Chemically synthesized oligonucleotide
agacccgggccagctcgaa

SEQ ID NO: 7869 - DNA, 19 bp, Artificial Sequence
  Description of Artificial Sequence: Chemically synthesized oligonucleotide
tcgagctggcccgggtctg

SEQ ID NO: 7870 - DNA, 19 bp, Artificial Sequence
  Description of Artificial Sequence: Chemically synthesized oligonucleotide
cagacccgggccagctcga

SEQ ID NO: 7871 - DNA, 19 bp, Artificial Sequence
  Description of Artificial Sequence: Chemically synthesized oligonucleotide
cgagctggcccgggtctgc

SEQ ID NO: 7872 - DNA, 19 bp, Artificial Sequence
  Description of Artificial Sequence: Chemically synthesized oligonucleotide
gcagacccgggccagctcg

SEQ ID NO: 7873 - DNA, 19 bp, Artificial Sequence
  Description of Artificial Sequence: Chemically synthesized oligonucleotide
gagctggcccgggtctgcg

SEQ ID NO: 7874 - DNA, 19 bp, Artificial Sequence
  Description of Artificial Sequence: Chemically synthesized oligonucleotide
cgcagacccgggccagctc

SEQ ID NO: 7875 - DNA, 19 bp, Artificial Sequence
  Description of Artificial Sequence: Chemically synthesized oligonucleotide
agctggcccgggtctgcgc

SEQ ID NO: 7876 - DNA, 19 bp, Artificial Sequence
  Description of Artificial Sequence: Chemically synthesized oligonucleotide
gcgcagacccgggccagct

SEQ ID NO: 7877 - DNA, 19 bp, Artificial Sequence
  Description of Artificial Sequence: Chemically synthesized oligonucleotide
gctggcccgggtctgcgca

SEQ ID NO: 7878 - DNA, 19 bp, Artificial Sequence
  Description of Artificial Sequence: Chemically synthesized oligonucleotide
tgcgcagacccgggccagc

SEQ ID NO: 7879 - DNA, 19 bp, Artificial Sequence
  Description of Artificial Sequence: Chemically synthesized oligonucleotide
ctggcccgggtctgcgcaa

SEQ ID NO: 7880 - DNA, 19 bp, Artificial Sequence
  Description of Artificial Sequence: Chemically synthesized oligonucleotide
ttgcgcagacccgggccag

SEQ ID NO: 7881 - DNA, 19 bp, Artificial Sequence
  Description of Artificial Sequence: Chemically synthesized oligonucleotide
tggcccgggtctgcgcaag

SEQ ID NO: 7882 - DNA, 19 bp, Artificial Sequence
  Description of Artificial Sequence: Chemically synthesized oligonucleotide
cttgcgcagacccgggcca

SEQ ID NO: 7883 - DNA, 19 bp, Artificial Sequence
  Description of Artificial Sequence: Chemically synthesized oligonucleotide
ggcccgggtctgcgcaagg

SEQ ID NO: 7884 - DNA, 19 bp, Artificial Sequence
  Description of Artificial Sequence: Chemically synthesized oligonucleotide
ccttgcgcagacccgggcc

SEQ ID NO: 7885 - DNA, 19 bp, Artificial Sequence
  Description of Artificial Sequence: Chemically synthesized oligonucleotide
gcccgggtctgcgcaaggg

SEQ ID NO: 7886 - DNA, 19 bp, Artificial Sequence
  Description of Artificial Sequence: Chemically synthesized oligonucleotide
cccttgcgcagacccgggc

SEQ ID NO: 7887 - DNA, 19 bp, Artificial Sequence
  Description of Artificial Sequence: Chemically synthesized oligonucleotide
cccgggtctgcgcaagggc

SEQ ID NO: 7888 - DNA, 19 bp, Artificial Sequence
  Description of Artificial Sequence: Chemically synthesized oligonucleotide
gcccttgcgcagacccggg

SEQ ID NO: 7889 - DNA, 19 bp, Artificial Sequence
  Description of Artificial Sequence: Chemically synthesized oligonucleotide
ccgggtctgcgcaagggcc

SEQ ID NO: 7890 - DNA, 19 bp, Artificial Sequence
  Description of Artificial Sequence: Chemically synthesized oligonucleotide
ggcccttgcgcagacccgg

SEQ ID NO: 7891 - DNA, 19 bp, Artificial Sequence
  Description of Artificial Sequence: Chemically synthesized oligonucleotide
cgggtctgcgcaagggcct

SEQ ID NO: 7892 - DNA, 19 bp, Artificial Sequence
  Description of Artificial Sequence: Chemically synthesized oligonucleotide
aggcccttgcgcagacccg

SEQ ID NO: 7893 - DNA, 19 bp, Artificial Sequence
  Description of Artificial Sequence: Chemically synthesized oligonucleotide
gggtctgcgcaagggcctg

SEQ ID NO: 7894 - DNA, 19 bp, Artificial Sequence
  Description of Artificial Sequence: Chemically synthesized oligonucleotide
caggcccttgcgcagaccc

SEQ ID NO: 7895 - DNA, 19 bp, Artificial Sequence
  Description of Artificial Sequence: Chemically synthesized oligonucleotide
ggtctgcgcaagggcctgg

SEQ ID NO: 7896 - DNA, 19 bp, Artificial Sequence
  Description of Artificial Sequence: Chemically synthesized oligonucleotide
ccaggcccttgcgcagacc

SEQ ID NO: 7897 - DNA, 19 bp, Artificial Sequence
  Description of Artificial Sequence: Chemically synthesized oligonucleotide
gtctgcgcaagggcctggg

SEQ ID NO: 7898 - DNA, 19 bp, Artificial Sequence
  Description of Artificial Sequence: Chemically synthesized oligonucleotide
cccaggcccttgcgcagac

SEQ ID NO: 7899 - DNA, 19 bp, Artificial Sequence
  Description of Artificial Sequence: Chemically synthesized oligonucleotide
tctgcgcaagggcctgggc

SEQ ID NO: 7900 - DNA, 19 bp, Artificial Sequence
  Description of Artificial Sequence: Chemically synthesized oligonucleotide
gcccaggcccttgcgcaga

SEQ ID NO: 7901 - DNA, 19 bp, Artificial Sequence
  Description of Artificial Sequence: Chemically synthesized oligonucleotide
ctgcgcaagggcctgggcc

SEQ ID NO: 7902 - DNA, 19 bp, Artificial Sequence
  Description of Artificial Sequence: Chemically synthesized oligonucleotide
ggcccaggcccttgcgcag

SEQ ID NO: 7903 - DNA, 19 bp, Artificial Sequence
  Description of Artificial Sequence: Chemically synthesized oligonucleotide
tgcgcaagggcctgggcct

SEQ ID NO: 7904 - DNA, 19 bp, Artificial Sequence
  Description of Artificial Sequence: Chemically synthesized oligonucleotide
aggcccaggcccttgcgca

SEQ ID NO: 7905 - DNA, 19 bp, Artificial Sequence
  Description of Artificial Sequence: Chemically synthesized oligonucleotide
gcgcaagggcctgggcctg

SEQ ID NO: 7906 - DNA, 19 bp, Artificial Sequence
  Description of Artificial Sequence: Chemically synthesized oligonucleotide
caggcccaggcccttgcgc

SEQ ID NO: 7907 - DNA, 19 bp, Artificial Sequence
  Description of Artificial Sequence: Chemically synthesized oligonucleotide
cgcaagggcctgggcctgc

SEQ ID NO: 7908 - DNA, 19 bp, Artificial Sequence
  Description of Artificial Sequence: Chemically synthesized oligonucleotide
gcaggcccaggcccttgcg

SEQ ID NO: 7909 - DNA, 19 bp, Artificial Sequence
  Description of Artificial Sequence: Chemically synthesized oligonucleotide
gcaagggcctgggcctgcc

SEQ ID NO: 7910 - DNA, 19 bp, Artificial Sequence
  Description of Artificial Sequence: Chemically synthesized oligonucleotide
ggcaggcccaggcccttgc

SEQ ID NO: 7911 - DNA, 19 bp, Artificial Sequence
  Description of Artificial Sequence: Chemically synthesized oligonucleotide
caagggcctgggcctgccc

SEQ ID NO: 7912 - DNA, 19 bp, Artificial Sequence
  Description of Artificial Sequence: Chemically synthesized oligonucleotide
gggcaggcccaggcccttg

SEQ ID NO: 7913 - DNA, 19 bp, Artificial Sequence
  Description of Artificial Sequence: Chemically synthesized oligonucleotide
aagggcctgggcctgcccc

SEQ ID NO: 7914 - DNA, 19 bp, Artificial Sequence
  Description of Artificial Sequence: Chemically synthesized oligonucleotide
ggggcaggcccaggccctt

SEQ ID NO: 7915 - DNA, 19 bp, Artificial Sequence
  Description of Artificial Sequence: Chemically synthesized oligonucleotide
agggcctgggcctgcccct

SEQ ID NO: 7916 - DNA, 19 bp, Artificial Sequence
  Description of Artificial Sequence: Chemically synthesized oligonucleotide
aggggcaggcccaggccct

SEQ ID NO: 7917 - DNA, 19 bp, Artificial Sequence
  Description of Artificial Sequence: Chemically synthesized oligonucleotide
gggcctgggcctgcccctc

SEQ ID NO: 7918 - DNA, 19 bp, Artificial Sequence
  Description of Artificial Sequence: Chemically synthesized oligonucleotide
gaggggcaggcccaggccc

SEQ ID NO: 7919 - DNA, 19 bp, Artificial Sequence
  Description of Artificial Sequence: Chemically synthesized oligonucleotide
ggcctgggcctgcccctct

SEQ ID NO: 7920 - DNA, 19 bp, Artificial Sequence
  Description of Artificial Sequence: Chemically synthesized oligonucleotide
agaggggcaggcccaggcc

SEQ ID NO: 7921 - DNA, 19 bp, Artificial Sequence
  Description of Artificial Sequence: Chemically synthesized oligonucleotide
gcctgggcctgcccctctc

SEQ ID NO: 7922 - DNA, 19 bp, Artificial Sequence
  Description of Artificial Sequence: Chemically synthesized oligonucleotide
gagaggggcaggcccaggc

SEQ ID NO: 7923 - DNA, 19 bp, Artificial Sequence
  Description of Artificial Sequence: Chemically synthesized oligonucleotide
cctgggcctgcccctctct

SEQ ID NO: 7924 - DNA, 19 bp, Artificial Sequence
  Description of Artificial Sequence: Chemically synthesized oligonucleotide
agagaggggcaggcccagg

SEQ ID NO: 7925 - DNA, 19 bp, Artificial Sequence
  Description of Artificial Sequence: Chemically synthesized oligonucleotide
ctgggcctgcccctctctc

SEQ ID NO: 7926 - DNA, 19 bp, Artificial Sequence
  Description of Artificial Sequence: Chemically synthesized oligonucleotide
gagagaggggcaggcccag

SEQ ID NO: 7927 - DNA, 19 bp, Artificial Sequence
  Description of Artificial Sequence: Chemically synthesized oligonucleotide
tgggcctgcccctctctcc

SEQ ID NO: 7928 - DNA, 19 bp, Artificial Sequence
  Description of Artificial Sequence: Chemically synthesized oligonucleotide
ggagagaggggcaggccca

SEQ ID NO: 7929 - DNA, 19 bp, Artificial Sequence
  Description of Artificial Sequence: Chemically synthesized oligonucleotide
gggcctgcccctctctcca

SEQ ID NO: 7930 - DNA, 19 bp, Artificial Sequence
  Description of Artificial Sequence: Chemically synthesized oligonucleotide
tggagagaggggcaggccc

SEQ ID NO: 7931 - DNA, 19 bp, Artificial Sequence
  Description of Artificial Sequence: Chemically synthesized oligonucleotide
ggcctgcccctctctccag

SEQ ID NO: 7932 - DNA, 19 bp, Artificial Sequence
  Description of Artificial Sequence: Chemically synthesized oligonucleotide
ctggagagaggggcaggcc

SEQ ID NO: 7933 - DNA, 19 bp, Artificial Sequence
  Description of Artificial Sequence: Chemically synthesized oligonucleotide
gcctgcccctctctccagt

SEQ ID NO: 7934 - DNA, 19 bp, Artificial Sequence
  Description of Artificial Sequence: Chemically synthesized oligonucleotide
actggagagaggggcaggc

SEQ ID NO: 7935 - DNA, 19 bp, Artificial Sequence
  Description of Artificial Sequence: Chemically synthesized oligonucleotide
cctgcccctctctccagtg

SEQ ID NO: 7936 - DNA, 19 bp, Artificial Sequence
  Description of Artificial Sequence: Chemically synthesized oligonucleotide
cactggagagaggggcagg

SEQ ID NO: 7937 - DNA, 19 bp, Artificial Sequence
  Description of Artificial Sequence: Chemically synthesized oligonucleotide
ctgcccctctctccagtgc

SEQ ID NO: 7938 - DNA, 19 bp, Artificial Sequence
  Description of Artificial Sequence: Chemically synthesized oligonucleotide
gcactggagagaggggcag

SEQ ID NO: 7939 - DNA, 19 bp, Artificial Sequence
  Description of Artificial Sequence: Chemically synthesized oligonucleotide
tgcccctctctccagtgcg

SEQ ID NO: 7940 - DNA, 19 bp, Artificial Sequence
  Description of Artificial Sequence: Chemically synthesized oligonucleotide
cgcactggagagaggggca

SEQ ID NO: 7941 - DNA, 19 bp, Artificial Sequence
  Description of Artificial Sequence: Chemically synthesized oligonucleotide
gcccctctctccagtgcgg

SEQ ID NO: 7942 - DNA, 19 bp, Artificial Sequence
  Description of Artificial Sequence: Chemically synthesized oligonucleotide
ccgcactggagagaggggc

SEQ ID NO: 7943 - DNA, 19 bp, Artificial Sequence
  Description of Artificial Sequence: Chemically synthesized oligonucleotide
cccctctctccagtgcggc

SEQ ID NO: 7944 - DNA, 19 bp, Artificial Sequence
  Description of Artificial Sequence: Chemically synthesized oligonucleotide
gccgcactggagagagggg

SEQ ID NO: 7945 - DNA, 19 bp, Artificial Sequence
  Description of Artificial Sequence: Chemically synthesized oligonucleotide
ccctctctccagtgcggcc

SEQ ID NO: 7946 - DNA, 19 bp, Artificial Sequence
  Description of Artificial Sequence: Chemically synthesized oligonucleotide
ggccgcactggagagaggg

SEQ ID NO: 7947 - DNA, 19 bp, Artificial Sequence
  Description of Artificial Sequence: Chemically synthesized oligonucleotide
cctctctccagtgcggccc

SEQ ID NO: 7948 - DNA, 19 bp, Artificial Sequence
  Description of Artificial Sequence: Chemically synthesized oligonucleotide
gggccgcactggagagagg

SEQ ID NO: 7949 - DNA, 19 bp, Artificial Sequence
  Description of Artificial Sequence: Chemically synthesized oligonucleotide
ctctctccagtgcggcccc

SEQ ID NO: 7950 - DNA, 19 bp, Artificial Sequence
  Description of Artificial Sequence: Chemically synthesized oligonucleotide
ggggccgcactggagagag

SEQ ID NO: 7951 - DNA, 19 bp, Artificial Sequence
  Description of Artificial Sequence: Chemically synthesized oligonucleotide
tctctccagtgcggccccg

SEQ ID NO: 7952 - DNA, 19 bp, Artificial Sequence
  Description of Artificial Sequence: Chemically synthesized oligonucleotide
cggggccgcactggagaga

SEQ ID NO: 7953 - DNA, 19 bp, Artificial Sequence
  Description of Artificial Sequence: Chemically synthesized oligonucleotide
ctctccagtgcggccccgg

SEQ ID NO: 7954 - DNA, 19 bp, Artificial Sequence
  Description of Artificial Sequence: Chemically synthesized oligonucleotide
ccggggccgcactggagag

SEQ ID NO: 7955 - DNA, 19 bp, Artificial Sequence
  Description of Artificial Sequence: Chemically synthesized oligonucleotide
tctccagtgcggccccggc

SEQ ID NO: 7956 - DNA, 19 bp, Artificial Sequence
  Description of Artificial Sequence: Chemically synthesized oligonucleotide
gccggggccgcactggaga

SEQ ID NO: 7957 - DNA, 19 bp, Artificial Sequence
  Description of Artificial Sequence: Chemically synthesized oligonucleotide
ctccagtgcggccccggct

SEQ ID NO: 7958 - DNA, 19 bp, Artificial Sequence
  Description of Artificial Sequence: Chemically synthesized oligonucleotide
agccggggccgcactggag

SEQ ID NO: 7959 - DNA, 19 bp, Artificial Sequence
  Description of Artificial Sequence: Chemically synthesized oligonucleotide
tccagtgcggccccggctg

SEQ ID NO: 7960 - DNA, 19 bp, Artificial Sequence
  Description of Artificial Sequence: Chemically synthesized oligonucleotide
cagccggggccgcactgga

SEQ ID NO: 7961 - DNA, 19 bp, Artificial Sequence
  Description of Artificial Sequence: Chemically synthesized oligonucleotide
ccagtgcggccccggctgc

SEQ ID NO: 7962 - DNA, 19 bp, Artificial Sequence
  Description of Artificial Sequence: Chemically synthesized oligonucleotide
gcagccggggccgcactgg

SEQ ID NO: 7963 - DNA, 19 bp, Artificial Sequence
  Description of Artificial Sequence: Chemically synthesized oligonucleotide
cagtgcggccccggctgcc

SEQ ID NO: 7964 - DNA, 19 bp, Artificial Sequence
  Description of Artificial Sequence: Chemically synthesized oligonucleotide
ggcagccggggccgcactg

SEQ ID NO: 7965 - DNA, 19 bp, Artificial Sequence
  Description of Artificial Sequence: Chemically synthesized oligonucleotide
agtgcggccccggctgcct

SEQ ID NO: 7966 - DNA, 19 bp, Artificial Sequence
  Description of Artificial Sequence: Chemically synthesized oligonucleotide
aggcagccggggccgcact

SEQ ID NO: 7967 - DNA, 19 bp, Artificial Sequence
  Description of Artificial Sequence: Chemically synthesized oligonucleotide
gtgcggccccggctgcctc

SEQ ID NO: 7968 - DNA, 19 bp, Artificial Sequence
  Description of Artificial Sequence: Chemically synthesized oligonucleotide
gaggcagccggggccgcac

SEQ ID NO: 7969 - DNA, 19 bp, Artificial Sequence
  Description of Artificial Sequence: Chemically synthesized oligonucleotide
tgcggccccggctgcctcc

SEQ ID NO: 7970 - DNA, 19 bp, Artificial Sequence
  Description of Artificial Sequence: Chemically synthesized oligonucleotide
ggaggcagccggggccgca

SEQ ID NO: 7971 - DNA, 19 bp, Artificial Sequence
  Description of Artificial Sequence: Chemically synthesized oligonucleotide
gcggccccggctgcctccc

SEQ ID NO: 7972 - DNA, 19 bp, Artificial Sequence
  Description of Artificial Sequence: Chemically synthesized oligonucleotide
gggaggcagccggggccgc

SEQ ID NO: 7973 - DNA, 19 bp, Artificial Sequence
  Description of Artificial Sequence: Chemically synthesized oligonucleotide
cggccccggctgcctcccc

SEQ ID NO: 7974 - DNA, 19 bp, Artificial Sequence
  Description of Artificial Sequence: Chemically synthesized oligonucleotide
ggggaggcagccggggccg

SEQ ID NO: 7975 - DNA, 19 bp, Artificial Sequence
  Description of Artificial Sequence: Chemically synthesized oligonucleotide
ggccccggctgcctccccc

SEQ ID NO: 7976 - DNA, 19 bp, Artificial Sequence
  Description of Artificial Sequence: Chemically synthesized oligonucleotide
gggggaggcagccggggcc

SEQ ID NO: 7977 - DNA, 19 bp, Artificial Sequence
  Description of Artificial Sequence: Chemically synthesized oligonucleotide
gccccggctgcctccccca

SEQ ID NO: 7978 - DNA, 19 bp, Artificial Sequence
  Description of Artificial Sequence: Chemically synthesized oligonucleotide
tgggggaggcagccggggc

SEQ ID NO: 7979 - DNA, 19 bp, Artificial Sequence
  Description of Artificial Sequence: Chemically synthesized oligonucleotide
ccccggctgcctcccccag

SEQ ID NO: 7980 - DNA, 19 bp, Artificial Sequence
  Description of Artificial Sequence: Chemically synthesized oligonucleotide
ctgggggaggcagccgggg

SEQ ID NO: 7981 - DNA, 19 bp, Artificial Sequence
  Description of Artificial Sequence: Chemically synthesized oligonucleotide
cccggctgcctcccccagg

SEQ ID NO: 7982 - DNA, 19 bp, Artificial Sequence
  Description of Artificial Sequence: Chemically synthesized oligonucleotide
cctgggggaggcagccggg

SEQ ID NO: 7983 - DNA, 19 bp, Artificial Sequence
  Description of Artificial Sequence: Chemically synthesized oligonucleotide
ccggctgcctcccccaggg

SEQ ID NO: 7984 - DNA, 19 bp, Artificial Sequence
  Description of Artificial Sequence: Chemically synthesized oligonucleotide
ccctgggggaggcagccgg

SEQ ID NO: 7985 - DNA, 19 bp, Artificial Sequence
  Description of Artificial Sequence: Chemically synthesized oligonucleotide
cggctgcctcccccagggg

SEQ ID NO: 7986 - DNA, 19 bp, Artificial Sequence
  Description of Artificial Sequence: Chemically synthesized oligonucleotide
cccctgggggaggcagccg

SEQ ID NO: 7987 - DNA, 19 bp, Artificial Sequence
  Description of Artificial Sequence: Chemically synthesized oligonucleotide
ggctgcctcccccaggggc

SEQ ID NO: 7988 - DNA, 19 bp, Artificial Sequence
  Description of Artificial Sequence: Chemically synthesized oligonucleotide
gcccctgggggaggcagcc

SEQ ID NO: 7989 - DNA, 19 bp, Artificial Sequence
  Description of Artificial Sequence: Chemically synthesized oligonucleotide
gctgcctcccccaggggct

SEQ ID NO: 7990 - DNA, 19 bp, Artificial Sequence
  Description of Artificial Sequence: Chemically synthesized oligonucleotide
agcccctgggggaggcagc

SEQ ID NO: 7991 - DNA, 19 bp, Artificial Sequence
  Description of Artificial Sequence: Chemically synthesized oligonucleotide
ctgcctcccccaggggctt

SEQ ID NO: 7992 - DNA, 19 bp, Artificial Sequence
  Description of Artificial Sequence: Chemically synthesized oligonucleotide
aagcccctgggggaggcag

SEQ ID NO: 7993 - DNA, 19 bp, Artificial Sequence
  Description of Artificial Sequence: Chemically synthesized oligonucleotide
tgcctcccccaggggcttt

SEQ ID NO: 7994 - DNA, 19 bp, Artificial Sequence
  Description of Artificial Sequence: Chemically synthesized oligonucleotide
aaagcccctgggggaggca

SEQ ID NO: 7995 - DNA, 19 bp, Artificial Sequence
  Description of Artificial Sequence: Chemically synthesized oligonucleotide
gcctcccccaggggctttg

SEQ ID NO: 7996 - DNA, 19 bp, Artificial Sequence
  Description of Artificial Sequence: Chemically synthesized oligonucleotide
caaagcccctgggggaggc

SEQ ID NO: 7997 - DNA, 19 bp, Artificial Sequence
  Description of Artificial Sequence: Chemically synthesized oligonucleotide
cctcccccaggggctttgc

SEQ ID NO: 7998 - DNA, 19 bp, Artificial Sequence
  Description of Artificial Sequence: Chemically synthesized oligonucleotide
gcaaagcccctgggggagg

SEQ ID NO: 7999 - DNA, 19 bp, Artificial Sequence
  Description of Artificial Sequence: Chemically synthesized oligonucleotide
ctcccccaggggctttgct

SEQ ID NO: 8000 - DNA, 19 bp, Artificial Sequence
  Description of Artificial Sequence: Chemically synthesized oligonucleotide
agcaaagcccctgggggag

SEQ ID NO: 8001 - DNA, 19 bp, Artificial Sequence
  Description of Artificial Sequence: Chemically synthesized oligonucleotide
tcccccaggggctttgctg

SEQ ID NO: 8002 - DNA, 19 bp, Artificial Sequence
  Description of Artificial Sequence: Chemically synthesized oligonucleotide
cagcaaagcccctggggga

SEQ ID NO: 8003 - DNA, 19 bp, Artificial Sequence
  Description of Artificial Sequence: Chemically synthesized oligonucleotide
cccccaggggctttgctgt

SEQ ID NO: 8004 - DNA, 19 bp, Artificial Sequence
  Description of Artificial Sequence: Chemically synthesized oligonucleotide
acagcaaagcccctggggg

SEQ ID NO: 8005 - DNA, 19 bp, Artificial Sequence
  Description of Artificial Sequence: Chemically synthesized oligonucleotide
ccccaggggctttgctgtg

SEQ ID NO: 8006 - DNA, 19 bp, Artificial Sequence
  Description of Artificial Sequence: Chemically synthesized oligonucleotide
cacagcaaagcccctgggg

SEQ ID NO: 8007 - DNA, 19 bp, Artificial Sequence
  Description of Artificial Sequence: Chemically synthesized oligonucleotide
cccaggggctttgctgtgg

SEQ ID NO: 8008 - DNA, 19 bp, Artificial Sequence
  Description of Artificial Sequence: Chemically synthesized oligonucleotide
ccacagcaaagcccctggg

SEQ ID NO: 8009 - DNA, 19 bp, Artificial Sequence
  Description of Artificial Sequence: Chemically synthesized oligonucleotide
ccaggggctttgctgtggc

SEQ ID NO: 8010 - DNA, 19 bp, Artificial Sequence
  Description of Artificial Sequence: Chemically synthesized oligonucleotide
gccacagcaaagcccctgg

SEQ ID NO: 8011 - DNA, 19 bp, Artificial Sequence
  Description of Artificial Sequence: Chemically synthesized oligonucleotide
caggggctttgctgtggct

SEQ ID NO: 8012 - DNA, 19 bp, Artificial Sequence
  Description of Artificial Sequence: Chemically synthesized oligonucleotide
agccacagcaaagcccctg

SEQ ID NO: 8013 - DNA, 19 bp, Artificial Sequence
  Description of Artificial Sequence: Chemically synthesized oligonucleotide
aggggctttgctgtggctg

SEQ ID NO: 8014 - DNA, 19 bp, Artificial Sequence
  Description of Artificial Sequence: Chemically synthesized oligonucleotide
cagccacagcaaagcccct

SEQ ID NO: 8015 - DNA, 19 bp, Artificial Sequence
  Description of Artificial Sequence: Chemically synthesized oligonucleotide
ggggctttgctgtggctgc

SEQ ID NO: 8016 - DNA, 19 bp, Artificial Sequence
  Description of Artificial Sequence: Chemically synthesized oligonucleotide
gcagccacagcaaagcccc

SEQ ID NO: 8017 - DNA, 19 bp, Artificial Sequence
  Description of Artificial Sequence: Chemically synthesized oligonucleotide
gggctttgctgtggctgca

SEQ ID NO: 8018 - DNA, 19 bp, Artificial Sequence
  Description of Artificial Sequence: Chemically synthesized oligonucleotide
tgcagccacagcaaagccc

SEQ ID NO: 8019 - DNA, 19 bp, Artificial Sequence
  Description of Artificial Sequence: Chemically synthesized oligonucleotide
ggctttgctgtggctgcag

SEQ ID NO: 8020 - DNA, 19 bp, Artificial Sequence
  Description of Artificial Sequence: Chemically synthesized oligonucleotide
ctgcagccacagcaaagcc

SEQ ID NO: 8021 - DNA, 19 bp, Artificial Sequence
  Description of Artificial Sequence: Chemically synthesized oligonucleotide
gctttgctgtggctgcagg

SEQ ID NO: 8022 - DNA, 19 bp, Artificial Sequence
  Description of Artificial Sequence: Chemically synthesized oligonucleotide
cctgcagccacagcaaagc

SEQ ID NO: 8023 - DNA, 19 bp, Artificial Sequence
  Description of Artificial Sequence: Chemically synthesized oligonucleotide
ctttgctgtggctgcagga

SEQ ID NO: 8024 - DNA, 19 bp, Artificial Sequence
  Description of Artificial Sequence: Chemically synthesized oligonucleotide
tcctgcagccacagcaaag

SEQ ID NO: 8025 - DNA, 19 bp, Artificial Sequence
  Description of Artificial Sequence: Chemically synthesized oligonucleotide
tttgctgtggctgcaggag

SEQ ID NO: 8026 - DNA, 19 bp, Artificial Sequence
  Description of Artificial Sequence: Chemically synthesized oligonucleotide
ctcctgcagccacagcaaa

SEQ ID NO: 8027 - DNA, 19 bp, Artificial Sequence
  Description of Artificial Sequence: Chemically synthesized oligonucleotide
ttgctgtggctgcaggagc

SEQ ID NO: 8028 - DNA, 19 bp, Artificial Sequence
  Description of Artificial Sequence: Chemically synthesized oligonucleotide
gctcctgcagccacagcaa

SEQ ID NO: 8029 - DNA, 19 bp, Artificial Sequence
  Description of Artificial Sequence: Chemically synthesized oligonucleotide
tgctgtggctgcaggagcc

SEQ ID NO: 8030 - DNA, 19 bp, Artificial Sequence
  Description of Artificial Sequence: Chemically synthesized oligonucleotide
ggctcctgcagccacagca

SEQ ID NO: 8031 - DNA, 19 bp, Artificial Sequence
  Description of Artificial Sequence: Chemically synthesized oligonucleotide
gctgtggctgcaggagccc

SEQ ID NO: 8032 - DNA, 19 bp, Artificial Sequence
  Description of Artificial Sequence: Chemically synthesized oligonucleotide
gggctcctgcagccacagc

SEQ ID NO: 8033 - DNA, 19 bp, Artificial Sequence
  Description of Artificial Sequence: Chemically synthesized oligonucleotide
ctgtggctgcaggagcccc

SEQ ID NO: 8034 - DNA, 19 bp, Artificial Sequence
  Description of Artificial Sequence: Chemically synthesized oligonucleotide
ggggctcctgcagccacag

SEQ ID NO: 8035 - DNA, 19 bp, Artificial Sequence
  Description of Artificial Sequence: Chemically synthesized oligonucleotide
tgtggctgcaggagcccca

SEQ ID NO: 8036 - DNA, 19 bp, Artificial Sequence
  Description of Artificial Sequence: Chemically synthesized oligonucleotide
tggggctcctgcagccaca

SEQ ID NO: 8037 - DNA, 19 bp, Artificial Sequence
  Description of Artificial Sequence: Chemically synthesized oligonucleotide
gtggctgcaggagccccag

SEQ ID NO: 8038 - DNA, 19 bp, Artificial Sequence
  Description of Artificial Sequence: Chemically synthesized oligonucleotide
ctggggctcctgcagccac

SEQ ID NO: 8039 - DNA, 19 bp, Artificial Sequence
  Description of Artificial Sequence: Chemically synthesized oligonucleotide
tggctgcaggagccccagc

SEQ ID NO: 8040 - DNA, 19 bp, Artificial Sequence
  Description of Artificial Sequence: Chemically synthesized oligonucleotide
gctggggctcctgcagcca

SEQ ID NO: 8041 - DNA, 19 bp, Artificial Sequence
  Description of Artificial Sequence: Chemically synthesized oligonucleotide
ggctgcaggagccccagcc

SEQ ID NO: 8042 - DNA, 19 bp, Artificial Sequence
  Description of Artificial Sequence: Chemically synthesized oligonucleotide
ggctggggctcctgcagcc

SEQ ID NO: 8043 - DNA, 19 bp, Artificial Sequence
  Description of Artificial Sequence: Chemically synthesized oligonucleotide
gctgcaggagccccagcct

SEQ ID NO: 8044 - DNA, 19 bp, Artificial Sequence
  Description of Artificial Sequence: Chemically synthesized oligonucleotide
aggctggggctcctgcagc

SEQ ID NO: 8045 - DNA, 19 bp, Artificial Sequence
  Description of Artificial Sequence: Chemically synthesized oligonucleotide
ctgcaggagccccagcctt

SEQ ID NO: 8046 - DNA, 19 bp, Artificial Sequence
  Description of Artificial Sequence: Chemically synthesized oligonucleotide
aaggctggggctcctgcag

SEQ ID NO: 8047 - DNA, 19 bp, Artificial Sequence
  Description of Artificial Sequence: Chemically synthesized oligonucleotide
tgcaggagccccagccttg

SEQ ID NO: 8048 - DNA, 19 bp, Artificial Sequence
  Description of Artificial Sequence: Chemically synthesized oligonucleotide
caaggctggggctcctgca

SEQ ID NO: 8049 - DNA, 19 bp, Artificial Sequence
  Description of Artificial Sequence: Chemically synthesized oligonucleotide
gcaggagccccagccttgc

SEQ ID NO: 8050 - DNA, 19 bp, Artificial Sequence
  Description of Artificial Sequence: Chemically synthesized oligonucleotide
gcaaggctggggctcctgc

SEQ ID NO: 8051 - DNA, 19 bp, Artificial Sequence
  Description of Artificial Sequence: Chemically synthesized oligonucleotide
caggagccccagccttgcc

SEQ ID NO: 8052 - DNA, 19 bp, Artificial Sequence
  Description of Artificial Sequence: Chemically synthesized oligonucleotide
ggcaaggctggggctcctg

SEQ ID NO: 8053 - DNA, 19 bp, Artificial Sequence
  Description of Artificial Sequence: Chemically synthesized oligonucleotide
aggagccccagccttgccc

SEQ ID NO: 8054 - DNA, 19 bp, Artificial Sequence
  Description of Artificial Sequence: Chemically synthesized oligonucleotide
gggcaaggctggggctcct

SEQ ID NO: 8055 - DNA, 19 bp, Artificial Sequence
  Description of Artificial Sequence: Chemically synthesized oligonucleotide
ggagccccagccttgccct

SEQ ID NO: 8056 - DNA, 19 bp, Artificial Sequence
  Description of Artificial Sequence: Chemically synthesized oligonucleotide
agggcaaggctggggctcc

SEQ ID NO: 8057 - DNA, 19 bp, Artificial Sequence
  Description of Artificial Sequence: Chemically synthesized oligonucleotide
gagccccagccttgccctc

SEQ ID NO: 8058 - DNA, 19 bp, Artificial Sequence
  Description of Artificial Sequence: Chemically synthesized oligonucleotide
gagggcaaggctggggctc

SEQ ID NO: 8059 - DNA, 19 bp, Artificial Sequence
  Description of Artificial Sequence: Chemically synthesized oligonucleotide
agccccagccttgccctcg

SEQ ID NO: 8060 - DNA, 19 bp, Artificial Sequence
  Description of Artificial Sequence: Chemically synthesized oligonucleotide
cgagggcaaggctggggct

SEQ ID NO: 8061 - DNA, 19 bp, Artificial Sequence
  Description of Artificial Sequence: Chemically synthesized oligonucleotide
gccccagccttgccctcgg

SEQ ID NO: 8062 - DNA, 19 bp, Artificial Sequence
  Description of Artificial Sequence: Chemically synthesized oligonucleotide
ccgagggcaaggctggggc

SEQ ID NO: 8063 - DNA, 19 bp, Artificial Sequence
  Description of Artificial Sequence: Chemically synthesized oligonucleotide
ccccagccttgccctcggc

SEQ ID NO: 8064 - DNA, 19 bp, Artificial Sequence
  Description of Artificial Sequence: Chemically synthesized oligonucleotide
gccgagggcaaggctgggg

SEQ ID NO: 8065 - DNA, 19 bp, Artificial Sequence
  Description of Artificial Sequence: Chemically synthesized oligonucleotide
cccagccttgccctcggcg

SEQ ID NO: 8066 - DNA, 19 bp, Artificial Sequence
  Description of Artificial Sequence: Chemically synthesized oligonucleotide
cgccgagggcaaggctggg

SEQ ID NO: 8067 - DNA, 19 bp, Artificial Sequence
  Description of Artificial Sequence: Chemically synthesized oligonucleotide
ccagccttgccctcggcgt

SEQ ID NO: 8068 - DNA, 19 bp, Artificial Sequence
  Description of Artificial Sequence: Chemically synthesized oligonucleotide
acgccgagggcaaggctgg

SEQ ID NO: 8069 - DNA, 19 bp, Artificial Sequence
  Description of Artificial Sequence: Chemically synthesized oligonucleotide
cagccttgccctcggcgtg

SEQ ID NO: 8070 - DNA, 19 bp, Artificial Sequence
  Description of Artificial Sequence: Chemically synthesized oligonucleotide
cacgccgagggcaaggctg

SEQ ID NO: 8071 - DNA, 19 bp, Artificial Sequence
  Description of Artificial Sequence: Chemically synthesized oligonucleotide
agccttgccctcggcgtgg

SEQ ID NO: 8072 - DNA, 19 bp, Artificial Sequence
  Description of Artificial Sequence: Chemically synthesized oligonucleotide
ccacgccgagggcaaggct

SEQ ID NO: 8073 - DNA, 19 bp, Artificial Sequence
  Description of Artificial Sequence: Chemically synthesized oligonucleotide
gccttgccctcggcgtggc

SEQ ID NO: 8074 - DNA, 19 bp, Artificial Sequence
  Description of Artificial Sequence: Chemically synthesized oligonucleotide
gccacgccgagggcaaggc

SEQ ID NO: 8075 - DNA, 19 bp, Artificial Sequence
  Description of Artificial Sequence: Chemically synthesized oligonucleotide
ccttgccctcggcgtggct

SEQ ID NO: 8076 - DNA, 19 bp, Artificial Sequence
  Description of Artificial Sequence: Chemically synthesized oligonucleotide
agccacgccgagggcaagg

SEQ ID NO: 8077 - DNA, 19 bp, Artificial Sequence
  Description of Artificial Sequence: Chemically synthesized oligonucleotide
cttgccctcggcgtggctt

SEQ ID NO: 8078 - DNA, 19 bp, Artificial Sequence
  Description of Artificial Sequence: Chemically synthesized oligonucleotide
aagccacgccgagggcaag

SEQ ID NO: 8079 - DNA, 19 bp, Artificial Sequence
  Description of Artificial Sequence: Chemically synthesized oligonucleotide
ttgccctcggcgtggcttc

SEQ ID NO: 8080 - DNA, 19 bp, Artificial Sequence
  Description of Artificial Sequence: Chemically synthesized oligonucleotide
gaagccacgccgagggcaa

SEQ ID NO: 8081 - DNA, 19 bp, Artificial Sequence
  Description of Artificial Sequence: Chemically synthesized oligonucleotide
tgccctcggcgtggcttcc

SEQ ID NO: 8082 - DNA, 19 bp, Artificial Sequence
  Description of Artificial Sequence: Chemically synthesized oligonucleotide
ggaagccacgccgagggca

SEQ ID NO: 8083 - DNA, 19 bp, Artificial Sequence
  Description of Artificial Sequence: Chemically synthesized oligonucleotide
gccctcggcgtggcttcca

SEQ ID NO: 8084 - DNA, 19 bp, Artificial Sequence
  Description of Artificial Sequence: Chemically synthesized oligonucleotide
tggaagccacgccgagggc

SEQ ID NO: 8085 - DNA, 19 bp, Artificial Sequence
  Description of Artificial Sequence: Chemically synthesized oligonucleotide
ccctcggcgtggcttccac

SEQ ID NO: 8086 - DNA, 19 bp, Artificial Sequence
  Description of Artificial Sequence: Chemically synthesized oligonucleotide
gtggaagccacgccgaggg

SEQ ID NO: 8087 - DNA, 19 bp, Artificial Sequence
  Description of Artificial Sequence: Chemically synthesized oligonucleotide
cctcggcgtggcttccacc

SEQ ID NO: 8088 - DNA, 19 bp, Artificial Sequence
  Description of Artificial Sequence: Chemically synthesized oligonucleotide
ggtggaagccacgccgagg

SEQ ID NO: 8089 - DNA, 19 bp, Artificial Sequence
  Description of Artificial Sequence: Chemically synthesized oligonucleotide
ctcggcgtggcttccacct

SEQ ID NO: 8090 - DNA, 19 bp, Artificial Sequence
  Description of Artificial Sequence: Chemically synthesized oligonucleotide
aggtggaagccacgccgag

SEQ ID NO: 8091 - DNA, 19 bp, Artificial Sequence
  Description of Artificial Sequence: Chemically synthesized oligonucleotide
tcggcgtggcttccacctc

SEQ ID NO: 8092 - DNA, 19 bp, Artificial Sequence
  Description of Artificial Sequence: Chemically synthesized oligonucleotide
gaggtggaagccacgccga

SEQ ID NO: 8093 - DNA, 19 bp, Artificial Sequence
  Description of Artificial Sequence: Chemically synthesized oligonucleotide
cggcgtggcttccacctct

SEQ ID NO: 8094 - DNA, 19 bp, Artificial Sequence
  Description of Artificial Sequence: Chemically synthesized oligonucleotide
agaggtggaagccacgccg

SEQ ID NO: 8095 - DNA, 19 bp, Artificial Sequence
  Description of Artificial Sequence: Chemically synthesized oligonucleotide
ggcgtggcttccacctctt

SEQ ID NO: 8096 - DNA, 19 bp, Artificial Sequence
  Description of Artificial Sequence: Chemically synthesized oligonucleotide
aagaggtggaagccacgcc

SEQ ID NO: 8097 - DNA, 19 bp, Artificial Sequence
  Description of Artificial Sequence: Chemically synthesized oligonucleotide
gcgtggcttccacctcttc

SEQ ID NO: 8098 - DNA, 19 bp, Artificial Sequence
  Description of Artificial Sequence: Chemically synthesized oligonucleotide
gaagaggtggaagccacgc

SEQ ID NO: 8099 - DNA, 19 bp, Artificial Sequence
  Description of Artificial Sequence: Chemically synthesized oligonucleotide
cgtggcttccacctcttcc

SEQ ID NO: 8100 - DNA, 19 bp, Artificial Sequence
  Description of Artificial Sequence: Chemically synthesized oligonucleotide
ggaagaggtggaagccacg

SEQ ID NO: 8101 - DNA, 19 bp, Artificial Sequence
  Description of Artificial Sequence: Chemically synthesized oligonucleotide
gtggcttccacctcttcca

SEQ ID NO: 8102 - DNA, 19 bp, Artificial Sequence
  Description of Artificial Sequence: Chemically synthesized oligonucleotide
tggaagaggtggaagccac

SEQ ID NO: 8103 - DNA, 19 bp, Artificial Sequence
  Description of Artificial Sequence: Chemically synthesized oligonucleotide
tggcttccacctcttccag

SEQ ID NO: 8104 - DNA, 19 bp, Artificial Sequence
  Description of Artificial Sequence: Chemically synthesized oligonucleotide
ctggaagaggtggaagcca

SEQ ID NO: 8105 - DNA, 19 bp, Artificial Sequence
  Description of Artificial Sequence: Chemically synthesized oligonucleotide
ggcttccacctcttccagg

SEQ ID NO: 8106 - DNA, 19 bp, Artificial Sequence
  Description of Artificial Sequence: Chemically synthesized oligonucleotide
cctggaagaggtggaagcc

SEQ ID NO: 8107 - DNA, 19 bp, Artificial Sequence
  Description of Artificial Sequence: Chemically synthesized oligonucleotide
gcttccacctcttccagga

SEQ ID NO: 8108 - DNA, 19 bp, Artificial Sequence
  Description of Artificial Sequence: Chemically synthesized oligonucleotide
tcctggaagaggtggaagc

SEQ ID NO: 8109 - DNA, 19 bp, Artificial Sequence
  Description of Artificial Sequence: Chemically synthesized oligonucleotide
cttccacctcttccaggag

SEQ ID NO: 8110 - DNA, 19 bp, Artificial Sequence
  Description of Artificial Sequence: Chemically synthesized oligonucleotide
ctcctggaagaggtggaag

SEQ ID NO: 8111 - DNA, 19 bp, Artificial Sequence
  Description of Artificial Sequence: Chemically synthesized oligonucleotide
ttccacctcttccaggagc

SEQ ID NO: 8112 - DNA, 19 bp, Artificial Sequence
  Description of Artificial Sequence: Chemically synthesized oligonucleotide
gctcctggaagaggtggaa

SEQ ID NO: 8113 - DNA, 19 bp, Artificial Sequence
  Description of Artificial Sequence: Chemically synthesized oligonucleotide
tccacctcttccaggagca

SEQ ID NO: 8114 - DNA, 19 bp, Artificial Sequence
  Description of Artificial Sequence: Chemically synthesized oligonucleotide
tgctcctggaagaggtgga

SEQ ID NO: 8115 - DNA, 19 bp, Artificial Sequence
  Description of Artificial Sequence: Chemically synthesized oligonucleotide
ccacctcttccaggagcac

SEQ ID NO: 8116 - DNA, 19 bp, Artificial Sequence
  Description of Artificial Sequence: Chemically synthesized oligonucleotide
gtgctcctggaagaggtgg

SEQ ID NO: 8117 - DNA, 19 bp, Artificial Sequence
  Description of Artificial Sequence: Chemically synthesized oligonucleotide
cacctcttccaggagcact

SEQ ID NO: 8118 - DNA, 19 bp, Artificial Sequence
  Description of Artificial Sequence: Chemically synthesized oligonucleotide
agtgctcctggaagaggtg

SEQ ID NO: 8119 - DNA, 19 bp, Artificial Sequence
  Description of Artificial Sequence: Chemically synthesized oligonucleotide
acctcttccaggagcactg

SEQ ID NO: 8120 - DNA, 19 bp, Artificial Sequence
  Description of Artificial Sequence: Chemically synthesized oligonucleotide
cagtgctcctggaagaggt

SEQ ID NO: 8121 - DNA, 19 bp, Artificial Sequence
  Description of Artificial Sequence: Chemically synthesized oligonucleotide
cctcttccaggagcactgg

SEQ ID NO: 8122 - DNA, 19 bp, Artificial Sequence
  Description of Artificial Sequence: Chemically synthesized oligonucleotide
ccagtgctcctggaagagg

SEQ ID NO: 8123 - DNA, 19 bp, Artificial Sequence
  Description of Artificial Sequence: Chemically synthesized oligonucleotide
ctcttccaggagcactgga

SEQ ID NO: 8124 - DNA, 19 bp, Artificial Sequence
  Description of Artificial Sequence: Chemically synthesized oligonucleotide
tccagtgctcctggaagag

SEQ ID NO: 8125 - DNA, 19 bp, Artificial Sequence
  Description of Artificial Sequence: Chemically synthesized oligonucleotide
tcttccaggagcactggag

SEQ ID NO: 8126 - DNA, 19 bp, Artificial Sequence
  Description of Artificial Sequence: Chemically synthesized oligonucleotide
ctccagtgctcctggaaga

SEQ ID NO: 8127 - DNA, 19 bp, Artificial Sequence
  Description of Artificial Sequence: Chemically synthesized oligonucleotide
cttccaggagcactggagg

SEQ ID NO: 8128 - DNA, 19 bp, Artificial Sequence
  Description of Artificial Sequence: Chemically synthesized oligonucleotide
cctccagtgctcctggaag

SEQ ID NO: 8129 - DNA, 19 bp, Artificial Sequence
  Description of Artificial Sequence: Chemically synthesized oligonucleotide
ttccaggagcactggaggc

SEQ ID NO: 8130 - DNA, 19 bp, Artificial Sequence
  Description of Artificial Sequence: Chemically synthesized oligonucleotide
gcctccagtgctcctggaa

SEQ ID NO: 8131 - DNA, 19 bp, Artificial Sequence
  Description of Artificial Sequence: Chemically synthesized oligonucleotide
tccaggagcactggaggca

SEQ ID NO: 8132 - DNA, 19 bp, Artificial Sequence
  Description of Artificial Sequence: Chemically synthesized oligonucleotide
tgcctccagtgctcctgga

SEQ ID NO: 8133 - DNA, 19 bp, Artificial Sequence
  Description of Artificial Sequence: Chemically synthesized oligonucleotide
ccaggagcactggaggcag

SEQ ID NO: 8134 - DNA, 19 bp, Artificial Sequence
  Description of Artificial Sequence: Chemically synthesized oligonucleotide
ctgcctccagtgctcctgg

SEQ ID NO: 8135 - DNA, 19 bp, Artificial Sequence
  Description of Artificial Sequence: Chemically synthesized oligonucleotide
caggagcactggaggcagg

SEQ ID NO: 8136 - DNA, 19 bp, Artificial Sequence
  Description of Artificial Sequence: Chemically synthesized oligonucleotide
cctgcctccagtgctcctg

SEQ ID NO: 8137 - DNA, 19 bp, Artificial Sequence
  Description of Artificial Sequence: Chemically synthesized oligonucleotide
aggagcactggaggcaggg

SEQ ID NO: 8138 - DNA, 19 bp, Artificial Sequence
  Description of Artificial Sequence: Chemically synthesized oligonucleotide
ccctgcctccagtgctcct

SEQ ID NO: 8139 - DNA, 19 bp, Artificial Sequence
  Description of Artificial Sequence: Chemically synthesized oligonucleotide
ggagcactggaggcagggc

SEQ ID NO: 8140 - DNA, 19 bp, Artificial Sequence
  Description of Artificial Sequence: Chemically synthesized oligonucleotide
gccctgcctccagtgctcc

SEQ ID NO: 8141 - DNA, 19 bp, Artificial Sequence
  Description of Artificial Sequence: Chemically synthesized oligonucleotide
gagcactggaggcagggcc

SEQ ID NO: 8142 - DNA, 19 bp, Artificial Sequence
  Description of Artificial Sequence: Chemically synthesized oligonucleotide
ggccctgcctccagtgctc

SEQ ID NO: 8143 - DNA, 19 bp, Artificial Sequence
  Description of Artificial Sequence: Chemically synthesized oligonucleotide
agcactggaggcagggcca

SEQ ID NO: 8144 - DNA, 19 bp, Artificial Sequence
  Description of Artificial Sequence: Chemically synthesized oligonucleotide
tggccctgcctccagtgct

SEQ ID NO: 8145 - DNA, 19 bp, Artificial Sequence
  Description of Artificial Sequence: Chemically synthesized oligonucleotide
gcactggaggcagggccag

SEQ ID NO: 8146 - DNA, 19 bp, Artificial Sequence
  Description of Artificial Sequence: Chemically synthesized oligonucleotide
ctggccctgcctccagtgc

SEQ ID NO: 8147 - DNA, 19 bp, Artificial Sequence
  Description of Artificial Sequence: Chemically synthesized oligonucleotide
cactggaggcagggccagc

SEQ ID NO: 8148 - DNA, 19 bp, Artificial Sequence
  Description of Artificial Sequence: Chemically synthesized oligonucleotide
gctggccctgcctccagtg

SEQ ID NO: 8149 - DNA, 19 bp, Artificial Sequence
  Description of Artificial Sequence: Chemically synthesized oligonucleotide
actggaggcagggccagcc

SEQ ID NO: 8150 - DNA, 19 bp, Artificial Sequence
  Description of Artificial Sequence: Chemically synthesized oligonucleotide
ggctggccctgcctccagt

SEQ ID NO: 8151 - DNA, 19 bp, Artificial Sequence
  Description of Artificial Sequence: Chemically synthesized oligonucleotide
ctggaggcagggccagcct

SEQ ID NO: 8152 - DNA, 19 bp, Artificial Sequence
  Description of Artificial Sequence: Chemically synthesized oligonucleotide
aggctggccctgcctccag

SEQ ID NO: 8153 - DNA, 19 bp, Artificial Sequence
  Description of Artificial Sequence: Chemically synthesized oligonucleotide
tggaggcagggccagcctg

SEQ ID NO: 8154 - DNA, 19 bp, Artificial Sequence
  Description of Artificial Sequence: Chemically synthesized oligonucleotide
caggctggccctgcctcca

SEQ ID NO: 8155 - DNA, 19 bp, Artificial Sequence
  Description of Artificial Sequence: Chemically synthesized oligonucleotide
ggaggcagggccagcctgt

SEQ ID NO: 8156 - DNA, 19 bp, Artificial Sequence
  Description of Artificial Sequence: Chemically synthesized oligonucleotide
acaggctggccctgcctcc

SEQ ID NO: 8157 - DNA, 19 bp, Artificial Sequence
  Description of Artificial Sequence: Chemically synthesized oligonucleotide
gaggcagggccagcctgtg

SEQ ID NO: 8158 - DNA, 19 bp, Artificial Sequence
  Description of Artificial Sequence: Chemically synthesized oligonucleotide
cacaggctggccctgcctc

SEQ ID NO: 8159 - DNA, 19 bp, Artificial Sequence
  Description of Artificial Sequence: Chemically synthesized oligonucleotide
aggcagggccagcctgtgt

SEQ ID NO: 8160 - DNA, 19 bp, Artificial Sequence
  Description of Artificial Sequence: Chemically synthesized oligonucleotide
acacaggctggccctgcct

SEQ ID NO: 8161 - DNA, 19 bp, Artificial Sequence
  Description of Artificial Sequence: Chemically synthesized oligonucleotide
ggcagggccagcctgtgtt

SEQ ID NO: 8162 - DNA, 19 bp, Artificial Sequence
  Description of Artificial Sequence: Chemically synthesized oligonucleotide
aacacaggctggccctgcc

SEQ ID NO: 8163 - DNA, 19 bp, Artificial Sequence
  Description of Artificial Sequence: Chemically synthesized oligonucleotide
gcagggccagcctgtgttg

SEQ ID NO: 8164 - DNA, 19 bp, Artificial Sequence
  Description of Artificial Sequence: Chemically synthesized oligonucleotide
caacacaggctggccctgc

SEQ ID NO: 8165 - DNA, 19 bp, Artificial Sequence
  Description of Artificial Sequence: Chemically synthesized oligonucleotide
cagggccagcctgtgttgg

SEQ ID NO: 8166 - DNA, 19 bp, Artificial Sequence
  Description of Artificial Sequence: Chemically synthesized oligonucleotide
ccaacacaggctggccctg

SEQ ID NO: 8167 - DNA, 19 bp, Artificial Sequence
  Description of Artificial Sequence: Chemically synthesized oligonucleotide
agggccagcctgtgttggt

SEQ ID NO: 8168 - DNA, 19 bp, Artificial Sequence
  Description of Artificial Sequence: Chemically synthesized oligonucleotide
accaacacaggctggccct

SEQ ID NO: 8169 - DNA, 19 bp, Artificial Sequence
  Description of Artificial Sequence: Chemically synthesized oligonucleotide
gggccagcctgtgttggtg

SEQ ID NO: 8170 - DNA, 19 bp, Artificial Sequence
  Description of Artificial Sequence: Chemically synthesized oligonucleotide
caccaacacaggctggccc

SEQ ID NO: 8171 - DNA, 19 bp, Artificial Sequence
  Description of Artificial Sequence: Chemically synthesized oligonucleotide
ggccagcctgtgttggtgt

SEQ ID NO: 8172 - DNA, 19 bp, Artificial Sequence
  Description of Artificial Sequence: Chemically synthesized oligonucleotide
acaccaacacaggctggcc

SEQ ID NO: 8173 - DNA, 19 bp, Artificial Sequence
  Description of Artificial Sequence: Chemically synthesized oligonucleotide
gccagcctgtgttggtgtc

SEQ ID NO: 8174 - DNA, 19 bp, Artificial Sequence
  Description of Artificial Sequence: Chemically synthesized oligonucleotide
gacaccaacacaggctggc

SEQ ID NO: 8175 - DNA, 19 bp, Artificial Sequence
  Description of Artificial Sequence: Chemically synthesized oligonucleotide
ccagcctgtgttggtgtca

SEQ ID NO: 8176 - DNA, 19 bp, Artificial Sequence
  Description of Artificial Sequence: Chemically synthesized oligonucleotide
tgacaccaacacaggctgg

SEQ ID NO: 8177 - DNA, 19 bp, Artificial Sequence
  Description of Artificial Sequence: Chemically synthesized oligonucleotide
cagcctgtgttggtgtcag

SEQ ID NO: 8178 - DNA, 19 bp, Artificial Sequence
  Description of Artificial Sequence: Chemically synthesized oligonucleotide
ctgacaccaacacaggctg

SEQ ID NO: 8179 - DNA, 19 bp, Artificial Sequence
  Description of Artificial Sequence: Chemically synthesized oligonucleotide
agcctgtgttggtgtcagg

SEQ ID NO: 8180 - DNA, 19 bp, Artificial Sequence
  Description of Artificial Sequence: Chemically synthesized oligonucleotide
cctgacaccaacacaggct

SEQ ID NO: 8181 - DNA, 19 bp, Artificial Sequence
  Description of Artificial Sequence: Chemically synthesized oligonucleotide
gcctgtgttggtgtcaggg

SEQ ID NO: 8182 - DNA, 19 bp, Artificial Sequence
  Description of Artificial Sequence: Chemically synthesized oligonucleotide
ccctgacaccaacacaggc

SEQ ID NO: 8183 - DNA, 19 bp, Artificial Sequence
  Description of Artificial Sequence: Chemically synthesized oligonucleotide
cctgtgttggtgtcaggga

SEQ ID NO: 8184 - DNA, 19 bp, Artificial Sequence
  Description of Artificial Sequence: Chemically synthesized oligonucleotide
tccctgacaccaacacagg

SEQ ID NO: 8185 - DNA, 19 bp, Artificial Sequence
  Description of Artificial Sequence: Chemically synthesized oligonucleotide
ctgtgttggtgtcagggat

SEQ ID NO: 8186 - DNA, 19 bp, Artificial Sequence
  Description of Artificial Sequence: Chemically synthesized oligonucleotide
atccctgacaccaacacag

SEQ ID NO: 8187 - DNA, 19 bp, Artificial Sequence
  Description of Artificial Sequence: Chemically synthesized oligonucleotide
tgtgttggtgtcagggatc

SEQ ID NO: 8188 - DNA, 19 bp, Artificial Sequence
  Description of Artificial Sequence: Chemically synthesized oligonucleotide
gatccctgacaccaacaca

SEQ ID NO: 8189 - DNA, 19 bp, Artificial Sequence
  Description of Artificial Sequence: Chemically synthesized oligonucleotide
gtgttggtgtcagggatcc

SEQ ID NO: 8190 - DNA, 19 bp, Artificial Sequence
  Description of Artificial Sequence: Chemically synthesized oligonucleotide
ggatccctgacaccaacac

SEQ ID NO: 8191 - DNA, 19 bp, Artificial Sequence
  Description of Artificial Sequence: Chemically synthesized oligonucleotide
tgttggtgtcagggatcca

SEQ ID NO: 8192 - DNA, 19 bp, Artificial Sequence
  Description of Artificial Sequence: Chemically synthesized oligonucleotide
tggatccctgacaccaaca

SEQ ID NO: 8193 - DNA, 19 bp, Artificial Sequence
  Description of Artificial Sequence: Chemically synthesized oligonucleotide
gttggtgtcagggatccaa

SEQ ID NO: 8194 - DNA, 19 bp, Artificial Sequence
  Description of Artificial Sequence: Chemically synthesized oligonucleotide
ttggatccctgacaccaac

SEQ ID NO: 8195 - DNA, 19 bp, Artificial Sequence
  Description of Artificial Sequence: Chemically synthesized oligonucleotide
ttggtgtcagggatccaaa

SEQ ID NO: 8196 - DNA, 19 bp, Artificial Sequence
  Description of Artificial Sequence: Chemically synthesized oligonucleotide
tttggatccctgacaccaa

SEQ ID NO: 8197 - DNA, 19 bp, Artificial Sequence
  Description of Artificial Sequence: Chemically synthesized oligonucleotide
tggtgtcagggatccaaag

SEQ ID NO: 8198 - DNA, 19 bp, Artificial Sequence
  Description of Artificial Sequence: Chemically synthesized oligonucleotide
ctttggatccctgacacca

SEQ ID NO: 8199 - DNA, 19 bp, Artificial Sequence
  Description of Artificial Sequence: Chemically synthesized oligonucleotide
ggtgtcagggatccaaagg

SEQ ID NO: 8200 - DNA, 19 bp, Artificial Sequence
  Description of Artificial Sequence: Chemically synthesized oligonucleotide
cctttggatccctgacacc

SEQ ID NO: 8201 - DNA, 19 bp, Artificial Sequence
  Description of Artificial Sequence: Chemically synthesized oligonucleotide
gtgtcagggatccaaagga

SEQ ID NO: 8202 - DNA, 19 bp, Artificial Sequence
  Description of Artificial Sequence: Chemically synthesized oligonucleotide
tcctttggatccctgacac

SEQ ID NO: 8203 - DNA, 19 bp, Artificial Sequence
  Description of Artificial Sequence: Chemically synthesized oligonucleotide
tgtcagggatccaaaggac

SEQ ID NO: 8204 - DNA, 19 bp, Artificial Sequence
  Description of Artificial Sequence: Chemically synthesized oligonucleotide
gtcctttggatccctgaca

SEQ ID NO: 8205 - DNA, 19 bp, Artificial Sequence
  Description of Artificial Sequence: Chemically synthesized oligonucleotide
gtcagggatccaaaggaca

SEQ ID NO: 8206 - DNA, 19 bp, Artificial Sequence
  Description of Artificial Sequence: Chemically synthesized oligonucleotide
tgtcctttggatccctgac

SEQ ID NO: 8207 - DNA, 19 bp, Artificial Sequence
  Description of Artificial Sequence: Chemically synthesized oligonucleotide
tcagggatccaaaggacat

SEQ ID NO: 8208 - DNA, 19 bp, Artificial Sequence
  Description of Artificial Sequence: Chemically synthesized oligonucleotide
atgtcctttggatccctga

SEQ ID NO: 8209 - DNA, 19 bp, Artificial Sequence
  Description of Artificial Sequence: Chemically synthesized oligonucleotide
cagggatccaaaggacatt

SEQ ID NO: 8210 - DNA, 19 bp, Artificial Sequence
  Description of Artificial Sequence: Chemically synthesized oligonucleotide
aatgtcctttggatccctg

SEQ ID NO: 8211 - DNA, 19 bp, Artificial Sequence
  Description of Artificial Sequence: Chemically synthesized oligonucleotide
agggatccaaaggacattg

SEQ ID NO: 8212 - DNA, 19 bp, Artificial Sequence
  Description of Artificial Sequence: Chemically synthesized oligonucleotide
caatgtcctttggatccct

SEQ ID NO: 8213 - DNA, 19 bp, Artificial Sequence
  Description of Artificial Sequence: Chemically synthesized oligonucleotide
gggatccaaaggacattgc

SEQ ID NO: 8214 - DNA, 19 bp, Artificial Sequence
  Description of Artificial Sequence: Chemically synthesized oligonucleotide
gcaatgtcctttggatccc

SEQ ID NO: 8215 - DNA, 19 bp, Artificial Sequence
  Description of Artificial Sequence: Chemically synthesized oligonucleotide
ggatccaaaggacattgca

SEQ ID NO: 8216 - DNA, 19 bp, Artificial Sequence
  Description of Artificial Sequence: Chemically synthesized oligonucleotide
tgcaatgtcctttggatcc

SEQ ID NO: 8217 - DNA, 19 bp, Artificial Sequence
  Description of Artificial Sequence: Chemically synthesized oligonucleotide
gatccaaaggacattgcag

SEQ ID NO: 8218 - DNA, 19 bp, Artificial Sequence
  Description of Artificial Sequence: Chemically synthesized oligonucleotide
ctgcaatgtcctttggatc

SEQ ID NO: 8219 - DNA, 19 bp, Artificial Sequence
  Description of Artificial Sequence: Chemically synthesized oligonucleotide
atccaaaggacattgcagg

SEQ ID NO: 8220 - DNA, 19 bp, Artificial Sequence
  Description of Artificial Sequence: Chemically synthesized oligonucleotide
cctgcaatgtcctttggat

SEQ ID NO: 8221 - DNA, 19 bp, Artificial Sequence
  Description of Artificial Sequence: Chemically synthesized oligonucleotide
tccaaaggacattgcaggg

SEQ ID NO: 8222 - DNA, 19 bp, Artificial Sequence
  Description of Artificial Sequence: Chemically synthesized oligonucleotide
ccctgcaatgtcctttgga

SEQ ID NO: 8223 - DNA, 19 bp, Artificial Sequence
  Description of Artificial Sequence: Chemically synthesized oligonucleotide
ccaaaggacattgcagggc

SEQ ID NO: 8224 - DNA, 19 bp, Artificial Sequence
  Description of Artificial Sequence: Chemically synthesized oligonucleotide
gccctgcaatgtcctttgg

SEQ ID NO: 8225 - DNA, 19 bp, Artificial Sequence
  Description of Artificial Sequence: Chemically synthesized oligonucleotide
caaaggacattgcagggca

SEQ ID NO: 8226 - DNA, 19 bp, Artificial Sequence
  Description of Artificial Sequence: Chemically synthesized oligonucleotide
tgccctgcaatgtcctttg

SEQ ID NO: 8227 - DNA, 19 bp, Artificial Sequence
  Description of Artificial Sequence: Chemically synthesized oligonucleotide
aaaggacattgcagggcaa

SEQ ID NO: 8228 - DNA, 19 bp, Artificial Sequence
  Description of Artificial Sequence: Chemically synthesized oligonucleotide
ttgccctgcaatgtccttt

SEQ ID NO: 8229 - DNA, 19 bp, Artificial Sequence
  Description of Artificial Sequence: Chemically synthesized oligonucleotide
aaggacattgcagggcaac

SEQ ID NO: 8230 - DNA, 19 bp, Artificial Sequence
  Description of Artificial Sequence: Chemically synthesized oligonucleotide
gttgccctgcaatgtcctt

SEQ ID NO: 8231 - DNA, 19 bp, Artificial Sequence
  Description of Artificial Sequence: Chemically synthesized oligonucleotide
aggacattgcagggcaacc

SEQ ID NO: 8232 - DNA, 19 bp, Artificial Sequence
  Description of Artificial Sequence: Chemically synthesized oligonucleotide
ggttgccctgcaatgtcct

SEQ ID NO: 8233 - DNA, 19 bp, Artificial Sequence
  Description of Artificial Sequence: Chemically synthesized oligonucleotide
ggacattgcagggcaacct

SEQ ID NO: 8234 - DNA, 19 bp, Artificial Sequence
  Description of Artificial Sequence: Chemically synthesized oligonucleotide
aggttgccctgcaatgtcc

SEQ ID NO: 8235 - DNA, 19 bp, Artificial Sequence
  Description of Artificial Sequence: Chemically synthesized oligonucleotide
gacattgcagggcaacctg

SEQ ID NO: 8236 - DNA, 19 bp, Artificial Sequence
  Description of Artificial Sequence: Chemically synthesized oligonucleotide
caggttgccctgcaatgtc

SEQ ID NO: 8237 - DNA, 19 bp, Artificial Sequence
  Description of Artificial Sequence: Chemically synthesized oligonucleotide
acattgcagggcaacctgt

SEQ ID NO: 8238 - DNA, 19 bp, Artificial Sequence
  Description of Artificial Sequence: Chemically synthesized oligonucleotide
acaggttgccctgcaatgt

SEQ ID NO: 8239 - DNA, 19 bp, Artificial Sequence
  Description of Artificial Sequence: Chemically synthesized oligonucleotide
cattgcagggcaacctgtg

SEQ ID NO: 8240 - DNA, 19 bp, Artificial Sequence
  Description of Artificial Sequence: Chemically synthesized oligonucleotide
cacaggttgccctgcaatg

SEQ ID NO: 8241 - DNA, 19 bp, Artificial Sequence
  Description of Artificial Sequence: Chemically synthesized oligonucleotide
attgcagggcaacctgtgg

SEQ ID NO: 8242 - DNA, 19 bp, Artificial Sequence
  Description of Artificial Sequence: Chemically synthesized oligonucleotide
ccacaggttgccctgcaat

SEQ ID NO: 8243 - DNA, 19 bp, Artificial Sequence
  Description of Artificial Sequence: Chemically synthesized oligonucleotide
ttgcagggcaacctgtggg

SEQ ID NO: 8244 - DNA, 19 bp, Artificial Sequence
  Description of Artificial Sequence: Chemically synthesized oligonucleotide
cccacaggttgccctgcaa

SEQ ID NO: 8245 - DNA, 19 bp, Artificial Sequence
  Description of Artificial Sequence: Chemically synthesized oligonucleotide
tgcagggcaacctgtgggg

SEQ ID NO: 8246 - DNA, 19 bp, Artificial Sequence
  Description of Artificial Sequence: Chemically synthesized oligonucleotide
ccccacaggttgccctgca

SEQ ID NO: 8247 - DNA, 19 bp, Artificial Sequence
  Description of Artificial Sequence: Chemically synthesized oligonucleotide
gcagggcaacctgtggggg

SEQ ID NO: 8248 - DNA, 19 bp, Artificial Sequence
  Description of Artificial Sequence: Chemically synthesized oligonucleotide
cccccacaggttgccctgc

SEQ ID NO: 8249 - DNA, 19 bp, Artificial Sequence
  Description of Artificial Sequence: Chemically synthesized oligonucleotide
cagggcaacctgtggggga

SEQ ID NO: 8250 - DNA, 19 bp, Artificial Sequence
  Description of Artificial Sequence: Chemically synthesized oligonucleotide
tcccccacaggttgccctg

SEQ ID NO: 8251 - DNA, 19 bp, Artificial Sequence
  Description of Artificial Sequence: Chemically synthesized oligonucleotide
agggcaacctgtgggggac

SEQ ID NO: 8252 - DNA, 19 bp, Artificial Sequence
  Description of Artificial Sequence: Chemically synthesized oligonucleotide
gtcccccacaggttgccct

SEQ ID NO: 8253 - DNA, 19 bp, Artificial Sequence
  Description of Artificial Sequence: Chemically synthesized oligonucleotide
gggcaacctgtgggggaca

SEQ ID NO: 8254 - DNA, 19 bp, Artificial Sequence
  Description of Artificial Sequence: Chemically synthesized oligonucleotide
tgtcccccacaggttgccc

SEQ ID NO: 8255 - DNA, 19 bp, Artificial Sequence
  Description of Artificial Sequence: Chemically synthesized oligonucleotide
ggcaacctgtgggggacag

SEQ ID NO: 8256 - DNA, 19 bp, Artificial Sequence
  Description of Artificial Sequence: Chemically synthesized oligonucleotide
ctgtcccccacaggttgcc

SEQ ID NO: 8257 - DNA, 19 bp, Artificial Sequence
  Description of Artificial Sequence: Chemically synthesized oligonucleotide
gcaacctgtgggggacaga

SEQ ID NO: 8258 - DNA, 19 bp, Artificial Sequence
  Description of Artificial Sequence: Chemically synthesized oligonucleotide
tctgtcccccacaggttgc

SEQ ID NO: 8259 - DNA, 19 bp, Artificial Sequence
  Description of Artificial Sequence: Chemically synthesized oligonucleotide
caacctgtgggggacagaa

SEQ ID NO: 8260 - DNA, 19 bp, Artificial Sequence
  Description of Artificial Sequence: Chemically synthesized oligonucleotide
ttctgtcccccacaggttg

SEQ ID NO: 8261 - DNA, 19 bp, Artificial Sequence
  Description of Artificial Sequence: Chemically synthesized oligonucleotide
aacctgtgggggacagaag

SEQ ID NO: 8262 - DNA, 19 bp, Artificial Sequence
  Description of Artificial Sequence: Chemically synthesized oligonucleotide
cttctgtcccccacaggtt

SEQ ID NO: 8263 - DNA, 19 bp, Artificial Sequence
  Description of Artificial Sequence: Chemically synthesized oligonucleotide
acctgtgggggacagaagc

SEQ ID NO: 8264 - DNA, 19 bp, Artificial Sequence
  Description of Artificial Sequence: Chemically synthesized oligonucleotide
gcttctgtcccccacaggt

SEQ ID NO: 8265 - DNA, 19 bp, Artificial Sequence
  Description of Artificial Sequence: Chemically synthesized oligonucleotide
cctgtgggggacagaagct

SEQ ID NO: 8266 - DNA, 19 bp, Artificial Sequence
  Description of Artificial Sequence: Chemically synthesized oligonucleotide
agcttctgtcccccacagg

SEQ ID NO: 8267 - DNA, 19 bp, Artificial Sequence
  Description of Artificial Sequence: Chemically synthesized oligonucleotide
ctgtgggggacagaagctc

SEQ ID NO: 8268 - DNA, 19 bp, Artificial Sequence
  Description of Artificial Sequence: Chemically synthesized oligonucleotide
gagcttctgtcccccacag

SEQ ID NO: 8269 - DNA, 19 bp, Artificial Sequence
  Description of Artificial Sequence: Chemically synthesized oligonucleotide
tgtgggggacagaagctct

SEQ ID NO: 8270 - DNA, 19 bp, Artificial Sequence
  Description of Artificial Sequence: Chemically synthesized oligonucleotide
agagcttctgtcccccaca

SEQ ID NO: 8271 - DNA, 19 bp, Artificial Sequence
  Description of Artificial Sequence: Chemically synthesized oligonucleotide
gtgggggacagaagctctt

SEQ ID NO: 8272 - DNA, 19 bp, Artificial Sequence
  Description of Artificial Sequence: Chemically synthesized oligonucleotide
aagagcttctgtcccccac

SEQ ID NO: 8273 - DNA, 19 bp, Artificial Sequence
  Description of Artificial Sequence: Chemically synthesized oligonucleotide
tgggggacagaagctcttg

SEQ ID NO: 8274 - DNA, 19 bp, Artificial Sequence
  Description of Artificial Sequence: Chemically synthesized oligonucleotide
caagagcttctgtccccca

SEQ ID NO: 8275 - DNA, 19 bp, Artificial Sequence
  Description of Artificial Sequence: Chemically synthesized oligonucleotide
gggggacagaagctcttgg

SEQ ID NO: 8276 - DNA, 19 bp, Artificial Sequence
  Description of Artificial Sequence: Chemically synthesized oligonucleotide
ccaagagcttctgtccccc

SEQ ID NO: 8277 - DNA, 19 bp, Artificial Sequence
  Description of Artificial Sequence: Chemically synthesized oligonucleotide
ggggacagaagctcttggg

SEQ ID NO: 8278 - DNA, 19 bp, Artificial Sequence
  Description of Artificial Sequence: Chemically synthesized oligonucleotide
cccaagagcttctgtcccc

SEQ ID NO: 8279 - DNA, 19 bp, Artificial Sequence
  Description of Artificial Sequence: Chemically synthesized oligonucleotide
gggacagaagctcttgggg

SEQ ID NO: 8280 - DNA, 19 bp, Artificial Sequence
  Description of Artificial Sequence: Chemically synthesized oligonucleotide
ccccaagagcttctgtccc

SEQ ID NO: 8281 - DNA, 19 bp, Artificial Sequence
  Description of Artificial Sequence: Chemically synthesized oligonucleotide
ggacagaagctcttggggc

SEQ ID NO: 8282 - DNA, 19 bp, Artificial Sequence
  Description of Artificial Sequence: Chemically synthesized oligonucleotide
gccccaagagcttctgtcc

SEQ ID NO: 8283 - DNA, 19 bp, Artificial Sequence
  Description of Artificial Sequence: Chemically synthesized oligonucleotide
gacagaagctcttggggca

SEQ ID NO: 8284 - DNA, 19 bp, Artificial Sequence
  Description of Artificial Sequence: Chemically synthesized oligonucleotide
tgccccaagagcttctgtc

SEQ ID NO: 8285 - DNA, 19 bp, Artificial Sequence
  Description of Artificial Sequence: Chemically synthesized oligonucleotide
acagaagctcttggggcac

SEQ ID NO: 8286 - DNA, 19 bp, Artificial Sequence
  Description of Artificial Sequence: Chemically synthesized oligonucleotide
gtgccccaagagcttctgt

SEQ ID NO: 8287 - DNA, 19 bp, Artificial Sequence
  Description of Artificial Sequence: Chemically synthesized oligonucleotide
cagaagctcttggggcact

SEQ ID NO: 8288 - DNA, 19 bp, Artificial Sequence
  Description of Artificial Sequence: Chemically synthesized oligonucleotide
agtgccccaagagcttctg

SEQ ID NO: 8289 - DNA, 19 bp, Artificial Sequence
  Description of Artificial Sequence: Chemically synthesized oligonucleotide
agaagctcttggggcactt

SEQ ID NO: 8290 - DNA, 19 bp, Artificial Sequence
  Description of Artificial Sequence: Chemically synthesized oligonucleotide
aagtgccccaagagcttct

SEQ ID NO: 8291 - DNA, 19 bp, Artificial Sequence
  Description of Artificial Sequence: Chemically synthesized oligonucleotide
gaagctcttggggcacttg

SEQ ID NO: 8292 - DNA, 19 bp, Artificial Sequence
  Description of Artificial Sequence: Chemically synthesized oligonucleotide
caagtgccccaagagcttc

SEQ ID NO: 8293 - DNA, 19 bp, Artificial Sequence
  Description of Artificial Sequence: Chemically synthesized oligonucleotide
aagctcttggggcacttgg

SEQ ID NO: 8294 - DNA, 19 bp, Artificial Sequence
  Description of Artificial Sequence: Chemically synthesized oligonucleotide
ccaagtgccccaagagctt

SEQ ID NO: 8295 - DNA, 19 bp, Artificial Sequence
  Description of Artificial Sequence: Chemically synthesized oligonucleotide
agctcttggggcacttgga

SEQ ID NO: 8296 - DNA, 19 bp, Artificial Sequence
  Description of Artificial Sequence: Chemically synthesized oligonucleotide
tccaagtgccccaagagct

SEQ ID NO: 8297 - DNA, 19 bp, Artificial Sequence
  Description of Artificial Sequence: Chemically synthesized oligonucleotide
gctcttggggcacttggag

SEQ ID NO: 8298 - DNA, 19 bp, Artificial Sequence
  Description of Artificial Sequence: Chemically synthesized oligonucleotide
ctccaagtgccccaagagc

SEQ ID NO: 8299 - DNA, 19 bp, Artificial Sequence
  Description of Artificial Sequence: Chemically synthesized oligonucleotide
ctcttggggcacttggagg

SEQ ID NO: 8300 - DNA, 19 bp, Artificial Sequence
  Description of Artificial Sequence: Chemically synthesized oligonucleotide
cctccaagtgccccaagag

SEQ ID NO: 8301 - DNA, 19 bp, Artificial Sequence
  Description of Artificial Sequence: Chemically synthesized oligonucleotide
tcttggggcacttggaggc

SEQ ID NO: 8302 - DNA, 19 bp, Artificial Sequence
  Description of Artificial Sequence: Chemically synthesized oligonucleotide
gcctccaagtgccccaaga

SEQ ID NO: 8303 - DNA, 19 bp, Artificial Sequence
  Description of Artificial Sequence: Chemically synthesized oligonucleotide
cttggggcacttggaggcc

SEQ ID NO: 8304 - DNA, 19 bp, Artificial Sequence
  Description of Artificial Sequence: Chemically synthesized oligonucleotide
ggcctccaagtgccccaag

SEQ ID NO: 8305 - DNA, 19 bp, Artificial Sequence
  Description of Artificial Sequence: Chemically synthesized oligonucleotide
ttggggcacttggaggcca

SEQ ID NO: 8306 - DNA, 19 bp, Artificial Sequence
  Description of Artificial Sequence: Chemically synthesized oligonucleotide
tggcctccaagtgccccaa

SEQ ID NO: 8307 - DNA, 19 bp, Artificial Sequence
  Description of Artificial Sequence: Chemically synthesized oligonucleotide
tggggcacttggaggccag

SEQ ID NO: 8308 - DNA, 19 bp, Artificial Sequence
  Description of Artificial Sequence: Chemically synthesized oligonucleotide
ctggcctccaagtgcccca

SEQ ID NO: 8309 - DNA, 19 bp, Artificial Sequence
  Description of Artificial Sequence: Chemically synthesized oligonucleotide
ggggcacttggaggccagg

SEQ ID NO: 8310 - DNA, 19 bp, Artificial Sequence
  Description of Artificial Sequence: Chemically synthesized oligonucleotide
cctggcctccaagtgcccc

SEQ ID NO: 8311 - DNA, 19 bp, Artificial Sequence
  Description of Artificial Sequence: Chemically synthesized oligonucleotide
gggcacttggaggccaggt

SEQ ID NO: 8312 - DNA, 19 bp, Artificial Sequence
  Description of Artificial Sequence: Chemically synthesized oligonucleotide
acctggcctccaagtgccc

SEQ ID NO: 8313 - DNA, 19 bp, Artificial Sequence
  Description of Artificial Sequence: Chemically synthesized oligonucleotide
ggcacttggaggccaggtg

SEQ ID NO: 8314 - DNA, 19 bp, Artificial Sequence
  Description of Artificial Sequence: Chemically synthesized oligonucleotide
cacctggcctccaagtgcc

SEQ ID NO: 8315 - DNA, 19 bp, Artificial Sequence
  Description of Artificial Sequence: Chemically synthesized oligonucleotide
gcacttggaggccaggtgc

SEQ ID NO: 8316 - DNA, 19 bp, Artificial Sequence
  Description of Artificial Sequence: Chemically synthesized oligonucleotide
gcacctggcctccaagtgc

SEQ ID NO: 8317 - DNA, 19 bp, Artificial Sequence
  Description of Artificial Sequence: Chemically synthesized oligonucleotide
cacttggaggccaggtgca

SEQ ID NO: 8318 - DNA, 19 bp, Artificial Sequence
  Description of Artificial Sequence: Chemically synthesized oligonucleotide
tgcacctggcctccaagtg

SEQ ID NO: 8319 - DNA, 19 bp, Artificial Sequence
  Description of Artificial Sequence: Chemically synthesized oligonucleotide
acttggaggccaggtgcag

SEQ ID NO: 8320 - DNA, 19 bp, Artificial Sequence
  Description of Artificial Sequence: Chemically synthesized oligonucleotide
ctgcacctggcctccaagt

SEQ ID NO: 8321 - DNA, 19 bp, Artificial Sequence
  Description of Artificial Sequence: Chemically synthesized oligonucleotide
cttggaggccaggtgcagg

SEQ ID NO: 8322 - DNA, 19 bp, Artificial Sequence
  Description of Artificial Sequence: Chemically synthesized oligonucleotide
cctgcacctggcctccaag

SEQ ID NO: 8323 - DNA, 19 bp, Artificial Sequence
  Description of Artificial Sequence: Chemically synthesized oligonucleotide
ttggaggccaggtgcaggc

SEQ ID NO: 8324 - DNA, 19 bp, Artificial Sequence
  Description of Artificial Sequence: Chemically synthesized oligonucleotide
gcctgcacctggcctccaa

SEQ ID NO: 8325 - DNA, 19 bp, Artificial Sequence
  Description of Artificial Sequence: Chemically synthesized oligonucleotide
tggaggccaggtgcaggcg

SEQ ID NO: 8326 - DNA, 19 bp, Artificial Sequence
  Description of Artificial Sequence: Chemically synthesized oligonucleotide
cgcctgcacctggcctcca

SEQ ID NO: 8327 - DNA, 19 bp, Artificial Sequence
  Description of Artificial Sequence: Chemically synthesized oligonucleotide
ggaggccaggtgcaggcgc

SEQ ID NO: 8328 - DNA, 19 bp, Artificial Sequence
  Description of Artificial Sequence: Chemically synthesized oligonucleotide
gcgcctgcacctggcctcc

SEQ ID NO: 8329 - DNA, 19 bp, Artificial Sequence
  Description of Artificial Sequence: Chemically synthesized oligonucleotide
gaggccaggtgcaggcgct

SEQ ID NO: 8330 - DNA, 19 bp, Artificial Sequence
  Description of Artificial Sequence: Chemically synthesized oligonucleotide
agcgcctgcacctggcctc

SEQ ID NO: 8331 - DNA, 19 bp, Artificial Sequence
  Description of Artificial Sequence: Chemically synthesized oligonucleotide
aggccaggtgcaggcgctg

SEQ ID NO: 8332 - DNA, 19 bp, Artificial Sequence
  Description of Artificial Sequence: Chemically synthesized oligonucleotide
cagcgcctgcacctggcct

SEQ ID NO: 8333 - DNA, 19 bp, Artificial Sequence
  Description of Artificial Sequence: Chemically synthesized oligonucleotide
ggccaggtgcaggcgctga

SEQ ID NO: 8334 - DNA, 19 bp, Artificial Sequence
  Description of Artificial Sequence: Chemically synthesized oligonucleotide
tcagcgcctgcacctggcc

SEQ ID NO: 8335 - DNA, 19 bp, Artificial Sequence
  Description of Artificial Sequence: Chemically synthesized oligonucleotide
gccaggtgcaggcgctgag

SEQ ID NO: 8336 - DNA, 19 bp, Artificial Sequence
  Description of Artificial Sequence: Chemically synthesized oligonucleotide
ctcagcgcctgcacctggc

SEQ ID NO: 8337 - DNA, 19 bp, Artificial Sequence
  Description of Artificial Sequence: Chemically synthesized oligonucleotide
ccaggtgcaggcgctgagc

SEQ ID NO: 8338 - DNA, 19 bp, Artificial Sequence
  Description of Artificial Sequence: Chemically synthesized oligonucleotide
gctcagcgcctgcacctgg

SEQ ID NO: 8339 - DNA, 19 bp, Artificial Sequence
  Description of Artificial Sequence: Chemically synthesized oligonucleotide
caggtgcaggcgctgagcc

SEQ ID NO: 8340 - DNA, 19 bp, Artificial Sequence
  Description of Artificial Sequence: Chemically synthesized oligonucleotide
ggctcagcgcctgcacctg

SEQ ID NO: 8341 - DNA, 19 bp, Artificial Sequence
  Description of Artificial Sequence: Chemically synthesized oligonucleotide
aggtgcaggcgctgagccc

SEQ ID NO: 8342 - DNA, 19 bp, Artificial Sequence
  Description of Artificial Sequence: Chemically synthesized oligonucleotide
gggctcagcgcctgcacct

SEQ ID NO: 8343 - DNA, 19 bp, Artificial Sequence
  Description of Artificial Sequence: Chemically synthesized oligonucleotide
ggtgcaggcgctgagcccc

SEQ ID NO: 8344 - DNA, 19 bp, Artificial Sequence
  Description of Artificial Sequence: Chemically synthesized oligonucleotide
ggggctcagcgcctgcacc

SEQ ID NO: 8345 - DNA, 19 bp, Artificial Sequence
  Description of Artificial Sequence: Chemically synthesized oligonucleotide
gtgcaggcgctgagccccc

SEQ ID NO: 8346 - DNA, 19 bp, Artificial Sequence
  Description of Artificial Sequence: Chemically synthesized oligonucleotide
gggggctcagcgcctgcac

SEQ ID NO: 8347 - DNA, 19 bp, Artificial Sequence
  Description of Artificial Sequence: Chemically synthesized oligonucleotide
tgcaggcgctgagccccct

SEQ ID NO: 8348 - DNA, 19 bp, Artificial Sequence
  Description of Artificial Sequence: Chemically synthesized oligonucleotide
agggggctcagcgcctgca

SEQ ID NO: 8349 - DNA, 19 bp, Artificial Sequence
  Description of Artificial Sequence: Chemically synthesized oligonucleotide
gcaggcgctgagccccctc

SEQ ID NO: 8350 - DNA, 19 bp, Artificial Sequence
  Description of Artificial Sequence: Chemically synthesized oligonucleotide
gagggggctcagcgcctgc

SEQ ID NO: 8351 - DNA, 19 bp, Artificial Sequence
  Description of Artificial Sequence: Chemically synthesized oligonucleotide
caggcgctgagccccctcg

SEQ ID NO: 8352 - DNA, 19 bp, Artificial Sequence
  Description of Artificial Sequence: Chemically synthesized oligonucleotide
cgagggggctcagcgcctg

SEQ ID NO: 8353 - DNA, 19 bp, Artificial Sequence
  Description of Artificial Sequence: Chemically synthesized oligonucleotide
aggcgctgagccccctcgg

SEQ ID NO: 8354 - DNA, 19 bp, Artificial Sequence
  Description of Artificial Sequence: Chemically synthesized oligonucleotide
ccgagggggctcagcgcct

SEQ ID NO: 8355 - DNA, 19 bp, Artificial Sequence
  Description of Artificial Sequence: Chemically synthesized oligonucleotide
ggcgctgagccccctcgga

SEQ ID NO: 8356 - DNA, 19 bp, Artificial Sequence
  Description of Artificial Sequence: Chemically synthesized oligonucleotide
tccgagggggctcagcgcc

SEQ ID NO: 8357 - DNA, 19 bp, Artificial Sequence
  Description of Artificial Sequence: Chemically synthesized oligonucleotide
gcgctgagccccctcggac

SEQ ID NO: 8358 - DNA, 19 bp, Artificial Sequence
  Description of Artificial Sequence: Chemically synthesized oligonucleotide
gtccgagggggctcagcgc

SEQ ID NO: 8359 - DNA, 19 bp, Artificial Sequence
  Description of Artificial Sequence: Chemically synthesized oligonucleotide
cgctgagccccctcggacc

SEQ ID NO: 8360 - DNA, 19 bp, Artificial Sequence
  Description of Artificial Sequence: Chemically synthesized oligonucleotide
ggtccgagggggctcagcg

SEQ ID NO: 8361 - DNA, 19 bp, Artificial Sequence
  Description of Artificial Sequence: Chemically synthesized oligonucleotide
gctgagccccctcggacct

SEQ ID NO: 8362 - DNA, 19 bp, Artificial Sequence
  Description of Artificial Sequence: Chemically synthesized oligonucleotide
aggtccgagggggctcagc

SEQ ID NO: 8363 - DNA, 19 bp, Artificial Sequence
  Description of Artificial Sequence: Chemically synthesized oligonucleotide
ctgagccccctcggacctc

SEQ ID NO: 8364 - DNA, 19 bp, Artificial Sequence
  Description of Artificial Sequence: Chemically synthesized oligonucleotide
gaggtccgagggggctcag

SEQ ID NO: 8365 - DNA, 19 bp, Artificial Sequence
  Description of Artificial Sequence: Chemically synthesized oligonucleotide
tgagccccctcggacctcc

SEQ ID NO: 8366 - DNA, 19 bp, Artificial Sequence
  Description of Artificial Sequence: Chemically synthesized oligonucleotide
ggaggtccgagggggctca

SEQ ID NO: 8367 - DNA, 19 bp, Artificial Sequence
  Description of Artificial Sequence: Chemically synthesized oligonucleotide
gagccccctcggacctccc

SEQ ID NO: 8368 - DNA, 19 bp, Artificial Sequence
  Description of Artificial Sequence: Chemically synthesized oligonucleotide
gggaggtccgagggggctc

SEQ ID NO: 8369 - DNA, 19 bp, Artificial Sequence
  Description of Artificial Sequence: Chemically synthesized oligonucleotide
agccccctcggacctcccc

SEQ ID NO: 8370 - DNA, 19 bp, Artificial Sequence
  Description of Artificial Sequence: Chemically synthesized oligonucleotide
ggggaggtccgagggggct

SEQ ID NO: 8371 - DNA, 19 bp, Artificial Sequence
  Description of Artificial Sequence: Chemically synthesized oligonucleotide
gccccctcggacctcccca

SEQ ID NO: 8372 - DNA, 19 bp, Artificial Sequence
  Description of Artificial Sequence: Chemically synthesized oligonucleotide
tggggaggtccgagggggc

SEQ ID NO: 8373 - DNA, 19 bp, Artificial Sequence
  Description of Artificial Sequence: Chemically synthesized oligonucleotide
ccccctcggacctccccag

SEQ ID NO: 8374 - DNA, 19 bp, Artificial Sequence
  Description of Artificial Sequence: Chemically synthesized oligonucleotide
ctggggaggtccgaggggg

SEQ ID NO: 8375 - DNA, 19 bp, Artificial Sequence
  Description of Artificial Sequence: Chemically synthesized oligonucleotide
cccctcggacctccccagc

SEQ ID NO: 8376 - DNA, 19 bp, Artificial Sequence
  Description of Artificial Sequence: Chemically synthesized oligonucleotide
gctggggaggtccgagggg

SEQ ID NO: 8377 - DNA, 19 bp, Artificial Sequence
  Description of Artificial Sequence: Chemically synthesized oligonucleotide
ccctcggacctccccagcc

SEQ ID NO: 8378 - DNA, 19 bp, Artificial Sequence
  Description of Artificial Sequence: Chemically synthesized oligonucleotide
ggctggggaggtccgaggg

SEQ ID NO: 8379 - DNA, 19 bp, Artificial Sequence
  Description of Artificial Sequence: Chemically synthesized oligonucleotide
cctcggacctccccagccc

SEQ ID NO: 8380 - DNA, 19 bp, Artificial Sequence
  Description of Artificial Sequence: Chemically synthesized oligonucleotide
gggctggggaggtccgagg

SEQ ID NO: 8381 - DNA, 19 bp, Artificial Sequence
  Description of Artificial Sequence: Chemically synthesized oligonucleotide
ctcggacctccccagccca

SEQ ID NO: 8382 - DNA, 19 bp, Artificial Sequence
  Description of Artificial Sequence: Chemically synthesized oligonucleotide
tgggctggggaggtccgag

SEQ ID NO: 8383 - DNA, 19 bp, Artificial Sequence
  Description of Artificial Sequence: Chemically synthesized oligonucleotide
tcggacctccccagcccag

SEQ ID NO: 8384 - DNA, 19 bp, Artificial Sequence
  Description of Artificial Sequence: Chemically synthesized oligonucleotide
ctgggctggggaggtccga

SEQ ID NO: 8385 - DNA, 19 bp, Artificial Sequence
  Description of Artificial Sequence: Chemically synthesized oligonucleotide
cggacctccccagcccagc

SEQ ID NO: 8386 - DNA, 19 bp, Artificial Sequence
  Description of Artificial Sequence: Chemically synthesized oligonucleotide
gctgggctggggaggtccg

SEQ ID NO: 8387 - DNA, 19 bp, Artificial Sequence
  Description of Artificial Sequence: Chemically synthesized oligonucleotide
ggacctccccagcccagca

SEQ ID NO: 8388 - DNA, 19 bp, Artificial Sequence
  Description of Artificial Sequence: Chemically synthesized oligonucleotide
tgctgggctggggaggtcc

SEQ ID NO: 8389 - DNA, 19 bp, Artificial Sequence
  Description of Artificial Sequence: Chemically synthesized oligonucleotide
gacctccccagcccagcag

SEQ ID NO: 8390 - DNA, 19 bp, Artificial Sequence
  Description of Artificial Sequence: Chemically synthesized oligonucleotide
ctgctgggctggggaggtc

SEQ ID NO: 8391 - DNA, 19 bp, Artificial Sequence
  Description of Artificial Sequence: Chemically synthesized oligonucleotide
acctccccagcccagcagc

SEQ ID NO: 8392 - DNA, 19 bp, Artificial Sequence
  Description of Artificial Sequence: Chemically synthesized oligonucleotide
gctgctgggctggggaggt

SEQ ID NO: 8393 - DNA, 19 bp, Artificial Sequence
  Description of Artificial Sequence: Chemically synthesized oligonucleotide
cctccccagcccagcagcc

SEQ ID NO: 8394 - DNA, 19 bp, Artificial Sequence
  Description of Artificial Sequence: Chemically synthesized oligonucleotide
ggctgctgggctggggagg

SEQ ID NO: 8395 - DNA, 19 bp, Artificial Sequence
  Description of Artificial Sequence: Chemically synthesized oligonucleotide
ctccccagcccagcagcct

SEQ ID NO: 8396 - DNA, 19 bp, Artificial Sequence
  Description of Artificial Sequence: Chemically synthesized oligonucleotide
aggctgctgggctggggag

SEQ ID NO: 8397 - DNA, 19 bp, Artificial Sequence
  Description of Artificial Sequence: Chemically synthesized oligonucleotide
tccccagcccagcagcctg

SEQ ID NO: 8398 - DNA, 19 bp, Artificial Sequence
  Description of Artificial Sequence: Chemically synthesized oligonucleotide
caggctgctgggctgggga

SEQ ID NO: 8399 - DNA, 19 bp, Artificial Sequence
  Description of Artificial Sequence: Chemically synthesized oligonucleotide
ccccagcccagcagcctgg

SEQ ID NO: 8400 - DNA, 19 bp, Artificial Sequence
  Description of Artificial Sequence: Chemically synthesized oligonucleotide
ccaggctgctgggctgggg

SEQ ID NO: 8401 - DNA, 19 bp, Artificial Sequence
  Description of Artificial Sequence: Chemically synthesized oligonucleotide
cccagcccagcagcctggg

SEQ ID NO: 8402 - DNA, 19 bp, Artificial Sequence
  Description of Artificial Sequence: Chemically synthesized oligonucleotide
cccaggctgctgggctggg

SEQ ID NO: 8403 - DNA, 19 bp, Artificial Sequence
  Description of Artificial Sequence: Chemically synthesized oligonucleotide
ccagcccagcagcctgggc

SEQ ID NO: 8404 - DNA, 19 bp, Artificial Sequence
  Description of Artificial Sequence: Chemically synthesized oligonucleotide
gcccaggctgctgggctgg

SEQ ID NO: 8405 - DNA, 19 bp, Artificial Sequence
  Description of Artificial Sequence: Chemically synthesized oligonucleotide
cagcccagcagcctgggca

SEQ ID NO: 8406 - DNA, 19 bp, Artificial Sequence
  Description of Artificial Sequence: Chemically synthesized oligonucleotide
tgcccaggctgctgggctg

SEQ ID NO: 8407 - DNA, 19 bp, Artificial Sequence
  Description of Artificial Sequence: Chemically synthesized oligonucleotide
agcccagcagcctgggcag

SEQ ID NO: 8408 - DNA, 19 bp, Artificial Sequence
  Description of Artificial Sequence: Chemically synthesized oligonucleotide
ctgcccaggctgctgggct

SEQ ID NO: 8409 - DNA, 19 bp, Artificial Sequence
  Description of Artificial Sequence: Chemically synthesized oligonucleotide
gcccagcagcctgggcagc

SEQ ID NO: 8410 - DNA, 19 bp, Artificial Sequence
  Description of Artificial Sequence: Chemically synthesized oligonucleotide
gctgcccaggctgctgggc

SEQ ID NO: 8411 - DNA, 19 bp, Artificial Sequence
  Description of Artificial Sequence: Chemically synthesized oligonucleotide
cccagcagcctgggcagca

SEQ ID NO: 8412 - DNA, 19 bp, Artificial Sequence
  Description of Artificial Sequence: Chemically synthesized oligonucleotide
tgctgcccaggctgctggg

SEQ ID NO: 8413 - DNA, 19 bp, Artificial Sequence
  Description of Artificial Sequence: Chemically synthesized oligonucleotide
ccagcagcctgggcagcac

SEQ ID NO: 8414 - DNA, 19 bp, Artificial Sequence
  Description of Artificial Sequence: Chemically synthesized oligonucleotide
gtgctgcccaggctgctgg

SEQ ID NO: 8415 - DNA, 19 bp, Artificial Sequence
  Description of Artificial Sequence: Chemically synthesized oligonucleotide
cagcagcctgggcagcaca

SEQ ID NO: 8416 - DNA, 19 bp, Artificial Sequence
  Description of Artificial Sequence: Chemically synthesized oligonucleotide
tgtgctgcccaggctgctg

SEQ ID NO: 8417 - DNA, 19 bp, Artificial Sequence
  Description of Artificial Sequence: Chemically synthesized oligonucleotide
agcagcctgggcagcacaa

SEQ ID NO: 8418 - DNA, 19 bp, Artificial Sequence
  Description of Artificial Sequence: Chemically synthesized oligonucleotide
ttgtgctgcccaggctgct

SEQ ID NO: 8419 - DNA, 19 bp, Artificial Sequence
  Description of Artificial Sequence: Chemically synthesized oligonucleotide
gcagcctgggcagcacaac

SEQ ID NO: 8420 - DNA, 19 bp, Artificial Sequence
  Description of Artificial Sequence: Chemically synthesized oligonucleotide
gttgtgctgcccaggctgc

SEQ ID NO: 8421 - DNA, 19 bp, Artificial Sequence
  Description of Artificial Sequence: Chemically synthesized oligonucleotide
cagcctgggcagcacaaca

SEQ ID NO: 8422 - DNA, 19 bp, Artificial Sequence
  Description of Artificial Sequence: Chemically synthesized oligonucleotide
tgttgtgctgcccaggctg

SEQ ID NO: 8423 - DNA, 19 bp, Artificial Sequence
  Description of Artificial Sequence: Chemically synthesized oligonucleotide
agcctgggcagcacaacat

SEQ ID NO: 8424 - DNA, 19 bp, Artificial Sequence
  Description of Artificial Sequence: Chemically synthesized oligonucleotide
atgttgtgctgcccaggct

SEQ ID NO: 8425 - DNA, 19 bp, Artificial Sequence
  Description of Artificial Sequence: Chemically synthesized oligonucleotide
gcctgggcagcacaacatt

SEQ ID NO: 8426 - DNA, 19 bp, Artificial Sequence
  Description of Artificial Sequence: Chemically synthesized oligonucleotide
aatgttgtgctgcccaggc

SEQ ID NO: 8427 - DNA, 19 bp, Artificial Sequence
  Description of Artificial Sequence: Chemically synthesized oligonucleotide
cctgggcagcacaacattc

SEQ ID NO: 8428 - DNA, 19 bp, Artificial Sequence
  Description of Artificial Sequence: Chemically synthesized oligonucleotide
gaatgttgtgctgcccagg

SEQ ID NO: 8429 - DNA, 19 bp, Artificial Sequence
  Description of Artificial Sequence: Chemically synthesized oligonucleotide
ctgggcagcacaacattct

SEQ ID NO: 8430 - DNA, 19 bp, Artificial Sequence
  Description of Artificial Sequence: Chemically synthesized oligonucleotide
agaatgttgtgctgcccag

SEQ ID NO: 8431 - DNA, 19 bp, Artificial Sequence
  Description of Artificial Sequence: Chemically synthesized oligonucleotide
tgggcagcacaacattctg

SEQ ID NO: 8432 - DNA, 19 bp, Artificial Sequence
  Description of Artificial Sequence: Chemically synthesized oligonucleotide
cagaatgttgtgctgccca

SEQ ID NO: 8433 - DNA, 19 bp, Artificial Sequence
  Description of Artificial Sequence: Chemically synthesized oligonucleotide
gggcagcacaacattctgg

SEQ ID NO: 8434 - DNA, 19 bp, Artificial Sequence
  Description of Artificial Sequence: Chemically synthesized oligonucleotide
ccagaatgttgtgctgccc

SEQ ID NO: 8435 - DNA, 19 bp, Artificial Sequence
  Description of Artificial Sequence: Chemically synthesized oligonucleotide
ggcagcacaacattctggg

SEQ ID NO: 8436 - DNA, 19 bp, Artificial Sequence
  Description of Artificial Sequence: Chemically synthesized oligonucleotide
cccagaatgttgtgctgcc

SEQ ID NO: 8437 - DNA, 19 bp, Artificial Sequence
  Description of Artificial Sequence: Chemically synthesized oligonucleotide
gcagcacaacattctggga

SEQ ID NO: 8438 - DNA, 19 bp, Artificial Sequence
  Description of Artificial Sequence: Chemically synthesized oligonucleotide
tcccagaatgttgtgctgc

SEQ ID NO: 8439 - DNA, 19 bp, Artificial Sequence
  Description of Artificial Sequence: Chemically synthesized oligonucleotide
cagcacaacattctgggag

SEQ ID NO: 8440 - DNA, 19 bp, Artificial Sequence
  Description of Artificial Sequence: Chemically synthesized oligonucleotide
ctcccagaatgttgtgctg

SEQ ID NO: 8441 - DNA, 19 bp, Artificial Sequence
  Description of Artificial Sequence: Chemically synthesized oligonucleotide
agcacaacattctgggagg

SEQ ID NO: 8442 - DNA, 19 bp, Artificial Sequence
  Description of Artificial Sequence: Chemically synthesized oligonucleotide
cctcccagaatgttgtgct

SEQ ID NO: 8443 - DNA, 19 bp, Artificial Sequence
  Description of Artificial Sequence: Chemically synthesized oligonucleotide
gcacaacattctgggaggg

SEQ ID NO: 8444 - DNA, 19 bp, Artificial Sequence
  Description of Artificial Sequence: Chemically synthesized oligonucleotide
ccctcccagaatgttgtgc

SEQ ID NO: 8445 - DNA, 19 bp, Artificial Sequence
  Description of Artificial Sequence: Chemically synthesized oligonucleotide
cacaacattctgggagggc

SEQ ID NO: 8446 - DNA, 19 bp, Artificial Sequence
  Description of Artificial Sequence: Chemically synthesized oligonucleotide
gccctcccagaatgttgtg

SEQ ID NO: 8447 - DNA, 19 bp, Artificial Sequence
  Description of Artificial Sequence: Chemically synthesized oligonucleotide
acaacattctgggagggct

SEQ ID NO: 8448 - DNA, 19 bp, Artificial Sequence
  Description of Artificial Sequence: Chemically synthesized oligonucleotide
agccctcccagaatgttgt

SEQ ID NO: 8449 - DNA, 19 bp, Artificial Sequence
  Description of Artificial Sequence: Chemically synthesized oligonucleotide
caacattctgggagggctt

SEQ ID NO: 8450 - DNA, 19 bp, Artificial Sequence
  Description of Artificial Sequence: Chemically synthesized oligonucleotide
aagccctcccagaatgttg

SEQ ID NO: 8451 - DNA, 19 bp, Artificial Sequence
  Description of Artificial Sequence: Chemically synthesized oligonucleotide
aacattctgggagggcttc

SEQ ID NO: 8452 - DNA, 19 bp, Artificial Sequence
  Description of Artificial Sequence: Chemically synthesized oligonucleotide
gaagccctcccagaatgtt

SEQ ID NO: 8453 - DNA, 19 bp, Artificial Sequence
  Description of Artificial Sequence: Chemically synthesized oligonucleotide
acattctgggagggcttct

SEQ ID NO: 8454 - DNA, 19 bp, Artificial Sequence
  Description of Artificial Sequence: Chemically synthesized oligonucleotide
agaagccctcccagaatgt

SEQ ID NO: 8455 - DNA, 19 bp, Artificial Sequence
  Description of Artificial Sequence: Chemically synthesized oligonucleotide
cattctgggagggcttctc

SEQ ID NO: 8456 - DNA, 19 bp, Artificial Sequence
  Description of Artificial Sequence: Chemically synthesized oligonucleotide
gagaagccctcccagaatg

SEQ ID NO: 8457 - DNA, 19 bp, Artificial Sequence
  Description of Artificial Sequence: Chemically synthesized oligonucleotide
attctgggagggcttctcc

SEQ ID NO: 8458 - DNA, 19 bp, Artificial Sequence
  Description of Artificial Sequence: Chemically synthesized oligonucleotide
ggagaagccctcccagaat

SEQ ID NO: 8459 - DNA, 19 bp, Artificial Sequence
  Description of Artificial Sequence: Chemically synthesized oligonucleotide
ttctgggagggcttctcct

SEQ ID NO: 8460 - DNA, 19 bp, Artificial Sequence
  Description of Artificial Sequence: Chemically synthesized oligonucleotide
aggagaagccctcccagaa

SEQ ID NO: 8461 - DNA, 19 bp, Artificial Sequence
  Description of Artificial Sequence: Chemically synthesized oligonucleotide
tctgggagggcttctcctg

SEQ ID NO: 8462 - DNA, 19 bp, Artificial Sequence
  Description of Artificial Sequence: Chemically synthesized oligonucleotide
caggagaagccctcccaga

SEQ ID NO: 8463 - DNA, 19 bp, Artificial Sequence
  Description of Artificial Sequence: Chemically synthesized oligonucleotide
ctgggagggcttctcctgg

SEQ ID NO: 8464 - DNA, 19 bp, Artificial Sequence
  Description of Artificial Sequence: Chemically synthesized oligonucleotide
ccaggagaagccctcccag

SEQ ID NO: 8465 - DNA, 19 bp, Artificial Sequence
  Description of Artificial Sequence: Chemically synthesized oligonucleotide
tgggagggcttctcctggc

SEQ ID NO: 8466 - DNA, 19 bp, Artificial Sequence
  Description of Artificial Sequence: Chemically synthesized oligonucleotide
gccaggagaagccctccca

SEQ ID NO: 8467 - DNA, 19 bp, Artificial Sequence
  Description of Artificial Sequence: Chemically synthesized oligonucleotide
gggagggcttctcctggcc

SEQ ID NO: 8468 - DNA, 19 bp, Artificial Sequence
  Description of Artificial Sequence: Chemically synthesized oligonucleotide
ggccaggagaagccctccc

SEQ ID NO: 8469 - DNA, 19 bp, Artificial Sequence
  Description of Artificial Sequence: Chemically synthesized oligonucleotide
ggagggcttctcctggcct

SEQ ID NO: 8470 - DNA, 19 bp, Artificial Sequence
  Description of Artificial Sequence: Chemically synthesized oligonucleotide
aggccaggagaagccctcc

SEQ ID NO: 8471 - DNA, 19 bp, Artificial Sequence
  Description of Artificial Sequence: Chemically synthesized oligonucleotide
gagggcttctcctggcctg

SEQ ID NO: 8472 - DNA, 19 bp, Artificial Sequence
  Description of Artificial Sequence: Chemically synthesized oligonucleotide
caggccaggagaagccctc

SEQ ID NO: 8473 - DNA, 19 bp, Artificial Sequence
  Description of Artificial Sequence: Chemically synthesized oligonucleotide
agggcttctcctggcctga

SEQ ID NO: 8474 - DNA, 19 bp, Artificial Sequence
  Description of Artificial Sequence: Chemically synthesized oligonucleotide
tcaggccaggagaagccct

SEQ ID NO: 8475 - DNA, 19 bp, Artificial Sequence
  Description of Artificial Sequence: Chemically synthesized oligonucleotide
gggcttctcctggcctgag

SEQ ID NO: 8476 - DNA, 19 bp, Artificial Sequence
  Description of Artificial Sequence: Chemically synthesized oligonucleotide
ctcaggccaggagaagccc

SEQ ID NO: 8477 - DNA, 19 bp, Artificial Sequence
  Description of Artificial Sequence: Chemically synthesized oligonucleotide
ggcttctcctggcctgagc

SEQ ID NO: 8478 - DNA, 19 bp, Artificial Sequence
  Description of Artificial Sequence: Chemically synthesized oligonucleotide
gctcaggccaggagaagcc

SEQ ID NO: 8479 - DNA, 19 bp, Artificial Sequence
  Description of Artificial Sequence: Chemically synthesized oligonucleotide
gcttctcctggcctgagct

SEQ ID NO: 8480 - DNA, 19 bp, Artificial Sequence
  Description of Artificial Sequence: Chemically synthesized oligonucleotide
agctcaggccaggagaagc

SEQ ID NO: 8481 - DNA, 19 bp, Artificial Sequence
  Description of Artificial Sequence: Chemically synthesized oligonucleotide
cttctcctggcctgagctt

SEQ ID NO: 8482 - DNA, 19 bp, Artificial Sequence
  Description of Artificial Sequence: Chemically synthesized oligonucleotide
aagctcaggccaggagaag

SEQ ID NO: 8483 - DNA, 19 bp, Artificial Sequence
  Description of Artificial Sequence: Chemically synthesized oligonucleotide
ttctcctggcctgagcttc

SEQ ID NO: 8484 - DNA, 19 bp, Artificial Sequence
  Description of Artificial Sequence: Chemically synthesized oligonucleotide
gaagctcaggccaggagaa

SEQ ID NO: 8485 - DNA, 19 bp, Artificial Sequence
  Description of Artificial Sequence: Chemically synthesized oligonucleotide
tctcctggcctgagcttcg

SEQ ID NO: 8486 - DNA, 19 bp, Artificial Sequence
  Description of Artificial Sequence: Chemically synthesized oligonucleotide
cgaagctcaggccaggaga

SEQ ID NO: 8487 - DNA, 19 bp, Artificial Sequence
  Description of Artificial Sequence: Chemically synthesized oligonucleotide
ctcctggcctgagcttcgc

SEQ ID NO: 8488 - DNA, 19 bp, Artificial Sequence
  Description of Artificial Sequence: Chemically synthesized oligonucleotide
gcgaagctcaggccaggag

SEQ ID NO: 8489 - DNA, 19 bp, Artificial Sequence
  Description of Artificial Sequence: Chemically synthesized oligonucleotide
tcctggcctgagcttcgcc

SEQ ID NO: 8490 - DNA, 19 bp, Artificial Sequence
  Description of Artificial Sequence: Chemically synthesized oligonucleotide
ggcgaagctcaggccagga

SEQ ID NO: 8491 - DNA, 19 bp, Artificial Sequence
  Description of Artificial Sequence: Chemically synthesized oligonucleotide
cctggcctgagcttcgccc

SEQ ID NO: 8492 - DNA, 19 bp, Artificial Sequence
  Description of Artificial Sequence: Chemically synthesized oligonucleotide
gggcgaagctcaggccagg

SEQ ID NO: 8493 - DNA, 19 bp, Artificial Sequence
  Description of Artificial Sequence: Chemically synthesized oligonucleotide
ctggcctgagcttcgccca

SEQ ID NO: 8494 - DNA, 19 bp, Artificial Sequence
  Description of Artificial Sequence: Chemically synthesized oligonucleotide
tgggcgaagctcaggccag

SEQ ID NO: 8495 - DNA, 19 bp, Artificial Sequence
  Description of Artificial Sequence: Chemically synthesized oligonucleotide
tggcctgagcttcgcccaa

SEQ ID NO: 8496 - DNA, 19 bp, Artificial Sequence
  Description of Artificial Sequence: Chemically synthesized oligonucleotide
ttgggcgaagctcaggcca

SEQ ID NO: 8497 - DNA, 19 bp, Artificial Sequence
  Description of Artificial Sequence: Chemically synthesized oligonucleotide
ggcctgagcttcgcccaaa

SEQ ID NO: 8498 - DNA, 19 bp, Artificial Sequence
  Description of Artificial Sequence: Chemically synthesized oligonucleotide
tttgggcgaagctcaggcc

SEQ ID NO: 8499 - DNA, 19 bp, Artificial Sequence
  Description of Artificial Sequence: Chemically synthesized oligonucleotide
gcctgagcttcgcccaaag

SEQ ID NO: 8500 - DNA, 19 bp, Artificial Sequence
  Description of Artificial Sequence: Chemically synthesized oligonucleotide
ctttgggcgaagctcaggc

SEQ ID NO: 8501 - DNA, 19 bp, Artificial Sequence
  Description of Artificial Sequence: Chemically synthesized oligonucleotide
cctgagcttcgcccaaagt

SEQ ID NO: 8502 - DNA, 19 bp, Artificial Sequence
  Description of Artificial Sequence: Chemically synthesized oligonucleotide
actttgggcgaagctcagg

SEQ ID NO: 8503 - DNA, 19 bp, Artificial Sequence
  Description of Artificial Sequence: Chemically synthesized oligonucleotide
ctgagcttcgcccaaagtc

SEQ ID NO: 8504 - DNA, 19 bp, Artificial Sequence
  Description of Artificial Sequence: Chemically synthesized oligonucleotide
gactttgggcgaagctcag

SEQ ID NO: 8505 - DNA, 19 bp, Artificial Sequence
  Description of Artificial Sequence: Chemically synthesized oligonucleotide
tgagcttcgcccaaagtca

SEQ ID NO: 8506 - DNA, 19 bp, Artificial Sequence
  Description of Artificial Sequence: Chemically synthesized oligonucleotide
tgactttgggcgaagctca

SEQ ID NO: 8507 - DNA, 19 bp, Artificial Sequence
  Description of Artificial Sequence: Chemically synthesized oligonucleotide
gagcttcgcccaaagtcag

SEQ ID NO: 8508 - DNA, 19 bp, Artificial Sequence
  Description of Artificial Sequence: Chemically synthesized oligonucleotide
ctgactttgggcgaagctc

SEQ ID NO: 8509 - DNA, 19 bp, Artificial Sequence
  Description of Artificial Sequence: Chemically synthesized oligonucleotide
agcttcgcccaaagtcaga

SEQ ID NO: 8510 - DNA, 19 bp, Artificial Sequence
  Description of Artificial Sequence: Chemically synthesized oligonucleotide
tctgactttgggcgaagct

SEQ ID NO: 8511 - DNA, 19 bp, Artificial Sequence
  Description of Artificial Sequence: Chemically synthesized oligonucleotide
gcttcgcccaaagtcagac

SEQ ID NO: 8512 - DNA, 19 bp, Artificial Sequence
  Description of Artificial Sequence: Chemically synthesized oligonucleotide
gtctgactttgggcgaagc

SEQ ID NO: 8513 - DNA, 19 bp, Artificial Sequence
  Description of Artificial Sequence: Chemically synthesized oligonucleotide
cttcgcccaaagtcagacg

SEQ ID NO: 8514 - DNA, 19 bp, Artificial Sequence
  Description of Artificial Sequence: Chemically synthesized oligonucleotide
cgtctgactttgggcgaag

SEQ ID NO: 8515 - DNA, 19 bp, Artificial Sequence
  Description of Artificial Sequence: Chemically synthesized oligonucleotide
ttcgcccaaagtcagacga

SEQ ID NO: 8516 - DNA, 19 bp, Artificial Sequence
  Description of Artificial Sequence: Chemically synthesized oligonucleotide
tcgtctgactttgggcgaa

SEQ ID NO: 8517 - DNA, 19 bp, Artificial Sequence
  Description of Artificial Sequence: Chemically synthesized oligonucleotide
tcgcccaaagtcagacgag

SEQ ID NO: 8518 - DNA, 19 bp, Artificial Sequence
  Description of Artificial Sequence: Chemically synthesized oligonucleotide
ctcgtctgactttgggcga

SEQ ID NO: 8519 - DNA, 19 bp, Artificial Sequence
  Description of Artificial Sequence: Chemically synthesized oligonucleotide
cgcccaaagtcagacgagg

SEQ ID NO: 8520 - DNA, 19 bp, Artificial Sequence
  Description of Artificial Sequence: Chemically synthesized oligonucleotide
cctcgtctgactttgggcg

SEQ ID NO: 8521 - DNA, 19 bp, Artificial Sequence
  Description of Artificial Sequence: Chemically synthesized oligonucleotide
gcccaaagtcagacgaggg

SEQ ID NO: 8522 - DNA, 19 bp, Artificial Sequence
  Description of Artificial Sequence: Chemically synthesized oligonucleotide
ccctcgtctgactttgggc

SEQ ID NO: 8523 - DNA, 19 bp, Artificial Sequence
  Description of Artificial Sequence: Chemically synthesized oligonucleotide
cccaaagtcagacgagggc

SEQ ID NO: 8524 - DNA, 19 bp, Artificial Sequence
  Description of Artificial Sequence: Chemically synthesized oligonucleotide
gccctcgtctgactttggg

SEQ ID NO: 8525 - DNA, 19 bp, Artificial Sequence
  Description of Artificial Sequence: Chemically synthesized oligonucleotide
ccaaagtcagacgagggct

SEQ ID NO: 8526 - DNA, 19 bp, Artificial Sequence
  Description of Artificial Sequence: Chemically synthesized oligonucleotide
agccctcgtctgactttgg

SEQ ID NO: 8527 - DNA, 19 bp, Artificial Sequence
  Description of Artificial Sequence: Chemically synthesized oligonucleotide
caaagtcagacgagggctc

SEQ ID NO: 8528 - DNA, 19 bp, Artificial Sequence
  Description of Artificial Sequence: Chemically synthesized oligonucleotide
gagccctcgtctgactttg

SEQ ID NO: 8529 - DNA, 19 bp, Artificial Sequence
  Description of Artificial Sequence: Chemically synthesized oligonucleotide
aaagtcagacgagggctct

SEQ ID NO: 8530 - DNA, 19 bp, Artificial Sequence
  Description of Artificial Sequence: Chemically synthesized oligonucleotide
agagccctcgtctgacttt

SEQ ID NO: 8531 - DNA, 19 bp, Artificial Sequence
  Description of Artificial Sequence: Chemically synthesized oligonucleotide
aagtcagacgagggctctg

SEQ ID NO: 8532 - DNA, 19 bp, Artificial Sequence
  Description of Artificial Sequence: Chemically synthesized oligonucleotide
cagagccctcgtctgactt

SEQ ID NO: 8533 - DNA, 19 bp, Artificial Sequence
  Description of Artificial Sequence: Chemically synthesized oligonucleotide
agtcagacgagggctctgt

SEQ ID NO: 8534 - DNA, 19 bp, Artificial Sequence
  Description of Artificial Sequence: Chemically synthesized oligonucleotide
acagagccctcgtctgact

SEQ ID NO: 8535 - DNA, 19 bp, Artificial Sequence
  Description of Artificial Sequence: Chemically synthesized oligonucleotide
gtcagacgagggctctgtc

SEQ ID NO: 8536 - DNA, 19 bp, Artificial Sequence
  Description of Artificial Sequence: Chemically synthesized oligonucleotide
gacagagccctcgtctgac

SEQ ID NO: 8537 - DNA, 19 bp, Artificial Sequence
  Description of Artificial Sequence: Chemically synthesized oligonucleotide
tcagacgagggctctgtcc

SEQ ID NO: 8538 - DNA, 19 bp, Artificial Sequence
  Description of Artificial Sequence: Chemically synthesized oligonucleotide
ggacagagccctcgtctga

SEQ ID NO: 8539 - DNA, 19 bp, Artificial Sequence
  Description of Artificial Sequence: Chemically synthesized oligonucleotide
cagacgagggctctgtcct

SEQ ID NO: 8540 - DNA, 19 bp, Artificial Sequence
  Description of Artificial Sequence: Chemically synthesized oligonucleotide
aggacagagccctcgtctg

SEQ ID NO: 8541 - DNA, 19 bp, Artificial Sequence
  Description of Artificial Sequence: Chemically synthesized oligonucleotide
agacgagggctctgtcctc

SEQ ID NO: 8542 - DNA, 19 bp, Artificial Sequence
  Description of Artificial Sequence: Chemically synthesized oligonucleotide
gaggacagagccctcgtct

SEQ ID NO: 8543 - DNA, 19 bp, Artificial Sequence
  Description of Artificial Sequence: Chemically synthesized oligonucleotide
gacgagggctctgtcctcc

SEQ ID NO: 8544 - DNA, 19 bp, Artificial Sequence
  Description of Artificial Sequence: Chemically synthesized oligonucleotide
ggaggacagagccctcgtc

SEQ ID NO: 8545 - DNA, 19 bp, Artificial Sequence
  Description of Artificial Sequence: Chemically synthesized oligonucleotide
acgagggctctgtcctcct

SEQ ID NO: 8546 - DNA, 19 bp, Artificial Sequence
  Description of Artificial Sequence: Chemically synthesized oligonucleotide
aggaggacagagccctcgt

SEQ ID NO: 8547 - DNA, 19 bp, Artificial Sequence
  Description of Artificial Sequence: Chemically synthesized oligonucleotide
cgagggctctgtcctcctg

SEQ ID NO: 8548 - DNA, 19 bp, Artificial Sequence
  Description of Artificial Sequence: Chemically synthesized oligonucleotide
caggaggacagagccctcg

SEQ ID NO: 8549 - DNA, 19 bp, Artificial Sequence
  Description of Artificial Sequence: Chemically synthesized oligonucleotide
gagggctctgtcctcctgc

SEQ ID NO: 8550 - DNA, 19 bp, Artificial Sequence
  Description of Artificial Sequence: Chemically synthesized oligonucleotide
gcaggaggacagagccctc

SEQ ID NO: 8551 - DNA, 19 bp, Artificial Sequence
  Description of Artificial Sequence: Chemically synthesized oligonucleotide
agggctctgtcctcctgct

SEQ ID NO: 8552 - DNA, 19 bp, Artificial Sequence
  Description of Artificial Sequence: Chemically synthesized oligonucleotide
agcaggaggacagagccct

SEQ ID NO: 8553 - DNA, 19 bp, Artificial Sequence
  Description of Artificial Sequence: Chemically synthesized oligonucleotide
gggctctgtcctcctgctg

SEQ ID NO: 8554 - DNA, 19 bp, Artificial Sequence
  Description of Artificial Sequence: Chemically synthesized oligonucleotide
cagcaggaggacagagccc

SEQ ID NO: 8555 - DNA, 19 bp, Artificial Sequence
  Description of Artificial Sequence: Chemically synthesized oligonucleotide
ggctctgtcctcctgctgc

SEQ ID NO: 8556 - DNA, 19 bp, Artificial Sequence
  Description of Artificial Sequence: Chemically synthesized oligonucleotide
gcagcaggaggacagagcc

SEQ ID NO: 8557 - DNA, 19 bp, Artificial Sequence
  Description of Artificial Sequence: Chemically synthesized oligonucleotide
gctctgtcctcctgctgca

SEQ ID NO: 8558 - DNA, 19 bp, Artificial Sequence
  Description of Artificial Sequence: Chemically synthesized oligonucleotide
tgcagcaggaggacagagc

SEQ ID NO: 8559 - DNA, 19 bp, Artificial Sequence
  Description of Artificial Sequence: Chemically synthesized oligonucleotide
ctctgtcctcctgctgcac

SEQ ID NO: 8560 - DNA, 19 bp, Artificial Sequence
  Description of Artificial Sequence: Chemically synthesized oligonucleotide
gtgcagcaggaggacagag

SEQ ID NO: 8561 - DNA, 19 bp, Artificial Sequence
  Description of Artificial Sequence: Chemically synthesized oligonucleotide
tctgtcctcctgctgcacc

SEQ ID NO: 8562 - DNA, 19 bp, Artificial Sequence
  Description of Artificial Sequence: Chemically synthesized oligonucleotide
ggtgcagcaggaggacaga

SEQ ID NO: 8563 - DNA, 19 bp, Artificial Sequence
  Description of Artificial Sequence: Chemically synthesized oligonucleotide
ctgtcctcctgctgcaccg

SEQ ID NO: 8564 - DNA, 19 bp, Artificial Sequence
  Description of Artificial Sequence: Chemically synthesized oligonucleotide
cggtgcagcaggaggacag

SEQ ID NO: 8565 - DNA, 19 bp, Artificial Sequence
  Description of Artificial Sequence: Chemically synthesized oligonucleotide
tgtcctcctgctgcaccga

SEQ ID NO: 8566 - DNA, 19 bp, Artificial Sequence
  Description of Artificial Sequence: Chemically synthesized oligonucleotide
tcggtgcagcaggaggaca

SEQ ID NO: 8567 - DNA, 19 bp, Artificial Sequence
  Description of Artificial Sequence: Chemically synthesized oligonucleotide
gtcctcctgctgcaccgag

SEQ ID NO: 8568 - DNA, 19 bp, Artificial Sequence
  Description of Artificial Sequence: Chemically synthesized oligonucleotide
ctcggtgcagcaggaggac

SEQ ID NO: 8569 - DNA, 19 bp, Artificial Sequence
  Description of Artificial Sequence: Chemically synthesized oligonucleotide
tcctcctgctgcaccgagc

SEQ ID NO: 8570 - DNA, 19 bp, Artificial Sequence
  Description of Artificial Sequence: Chemically synthesized oligonucleotide
gctcggtgcagcaggagga

SEQ ID NO: 8571 - DNA, 19 bp, Artificial Sequence
  Description of Artificial Sequence: Chemically synthesized oligonucleotide
cctcctgctgcaccgagct

SEQ ID NO: 8572 - DNA, 19 bp, Artificial Sequence
  Description of Artificial Sequence: Chemically synthesized oligonucleotide
agctcggtgcagcaggagg

SEQ ID NO: 8573 - DNA, 19 bp, Artificial Sequence
  Description of Artificial Sequence: Chemically synthesized oligonucleotide
ctcctgctgcaccgagctt

SEQ ID NO: 8574 - DNA, 19 bp, Artificial Sequence
  Description of Artificial Sequence: Chemically synthesized oligonucleotide
aagctcggtgcagcaggag

SEQ ID NO: 8575 - DNA, 19 bp, Artificial Sequence
  Description of Artificial Sequence: Chemically synthesized oligonucleotide
tcctgctgcaccgagcttt

SEQ ID NO: 8576 - DNA, 19 bp, Artificial Sequence
  Description of Artificial Sequence: Chemically synthesized oligonucleotide
aaagctcggtgcagcagga

SEQ ID NO: 8577 - DNA, 19 bp, Artificial Sequence
  Description of Artificial Sequence: Chemically synthesized oligonucleotide
cctgctgcaccgagctttg

SEQ ID NO: 8578 - DNA, 19 bp, Artificial Sequence
  Description of Artificial Sequence: Chemically synthesized oligonucleotide
caaagctcggtgcagcagg

SEQ ID NO: 8579 - DNA, 19 bp, Artificial Sequence
  Description of Artificial Sequence: Chemically synthesized oligonucleotide
ctgctgcaccgagctttgg

SEQ ID NO: 8580 - DNA, 19 bp, Artificial Sequence
  Description of Artificial Sequence: Chemically synthesized oligonucleotide
ccaaagctcggtgcagcag

SEQ ID NO: 8581 - DNA, 19 bp, Artificial Sequence
  Description of Artificial Sequence: Chemically synthesized oligonucleotide
tgctgcaccgagctttggg

SEQ ID NO: 8582 - DNA, 19 bp, Artificial Sequence
  Description of Artificial Sequence: Chemically synthesized oligonucleotide
cccaaagctcggtgcagca

SEQ ID NO: 8583 - DNA, 19 bp, Artificial Sequence
  Description of Artificial Sequence: Chemically synthesized oligonucleotide
gctgcaccgagctttgggg

SEQ ID NO: 8584 - DNA, 19 bp, Artificial Sequence
  Description of Artificial Sequence: Chemically synthesized oligonucleotide
ccccaaagctcggtgcagc

SEQ ID NO: 8585 - DNA, 19 bp, Artificial Sequence
  Description of Artificial Sequence: Chemically synthesized oligonucleotide
ctgcaccgagctttggggg

SEQ ID NO: 8586 - DNA, 19 bp, Artificial Sequence
  Description of Artificial Sequence: Chemically synthesized oligonucleotide
cccccaaagctcggtgcag

SEQ ID NO: 8587 - DNA, 19 bp, Artificial Sequence
  Description of Artificial Sequence: Chemically synthesized oligonucleotide
tgcaccgagctttggggga

SEQ ID NO: 8588 - DNA, 19 bp, Artificial Sequence
  Description of Artificial Sequence: Chemically synthesized oligonucleotide
tcccccaaagctcggtgca

SEQ ID NO: 8589 - DNA, 19 bp, Artificial Sequence
  Description of Artificial Sequence: Chemically synthesized oligonucleotide
gcaccgagctttgggggat

SEQ ID NO: 8590 - DNA, 19 bp, Artificial Sequence
  Description of Artificial Sequence: Chemically synthesized oligonucleotide
atcccccaaagctcggtgc

SEQ ID NO: 8591 - DNA, 19 bp, Artificial Sequence
  Description of Artificial Sequence: Chemically synthesized oligonucleotide
caccgagctttgggggatg

SEQ ID NO: 8592 - DNA, 19 bp, Artificial Sequence
  Description of Artificial Sequence: Chemically synthesized oligonucleotide
catcccccaaagctcggtg

SEQ ID NO: 8593 - DNA, 19 bp, Artificial Sequence
  Description of Artificial Sequence: Chemically synthesized oligonucleotide
accgagctttgggggatga

SEQ ID NO: 8594 - DNA, 19 bp, Artificial Sequence
  Description of Artificial Sequence: Chemically synthesized oligonucleotide
tcatcccccaaagctcggt

SEQ ID NO: 8595 - DNA, 19 bp, Artificial Sequence
  Description of Artificial Sequence: Chemically synthesized oligonucleotide
ccgagctttgggggatgag

SEQ ID NO: 8596 - DNA, 19 bp, Artificial Sequence
  Description of Artificial Sequence: Chemically synthesized oligonucleotide
ctcatcccccaaagctcgg

SEQ ID NO: 8597 - DNA, 19 bp, Artificial Sequence
  Description of Artificial Sequence: Chemically synthesized oligonucleotide
cgagctttgggggatgagg

SEQ ID NO: 8598 - DNA, 19 bp, Artificial Sequence
  Description of Artificial Sequence: Chemically synthesized oligonucleotide
cctcatcccccaaagctcg

SEQ ID NO: 8599 - DNA, 19 bp, Artificial Sequence
  Description of Artificial Sequence: Chemically synthesized oligonucleotide
gagctttgggggatgagga

SEQ ID NO: 8600 - DNA, 19 bp, Artificial Sequence
  Description of Artificial Sequence: Chemically synthesized oligonucleotide
tcctcatcccccaaagctc

SEQ ID NO: 8601 - DNA, 19 bp, Artificial Sequence
  Description of Artificial Sequence: Chemically synthesized oligonucleotide
agctttgggggatgaggac

SEQ ID NO: 8602 - DNA, 19 bp, Artificial Sequence
  Description of Artificial Sequence: Chemically synthesized oligonucleotide
gtcctcatcccccaaagct

SEQ ID NO: 8603 - DNA, 19 bp, Artificial Sequence
  Description of Artificial Sequence: Chemically synthesized oligonucleotide
gctttgggggatgaggaca

SEQ ID NO: 8604 - DNA, 19 bp, Artificial Sequence
  Description of Artificial Sequence: Chemically synthesized oligonucleotide
tgtcctcatcccccaaagc

SEQ ID NO: 8605 - DNA, 19 bp, Artificial Sequence
  Description of Artificial Sequence: Chemically synthesized oligonucleotide
ctttgggggatgaggacac

SEQ ID NO: 8606 - DNA, 19 bp, Artificial Sequence
  Description of Artificial Sequence: Chemically synthesized oligonucleotide
gtgtcctcatcccccaaag

SEQ ID NO: 8607 - DNA, 19 bp, Artificial Sequence
  Description of Artificial Sequence: Chemically synthesized oligonucleotide
tttgggggatgaggacacc

SEQ ID NO: 8608 - DNA, 19 bp, Artificial Sequence
  Description of Artificial Sequence: Chemically synthesized oligonucleotide
ggtgtcctcatcccccaaa

SEQ ID NO: 8609 - DNA, 19 bp, Artificial Sequence
  Description of Artificial Sequence: Chemically synthesized oligonucleotide
ttgggggatgaggacacca

SEQ ID NO: 8610 - DNA, 19 bp, Artificial Sequence
  Description of Artificial Sequence: Chemically synthesized oligonucleotide
tggtgtcctcatcccccaa

SEQ ID NO: 8611 - DNA, 19 bp, Artificial Sequence
  Description of Artificial Sequence: Chemically synthesized oligonucleotide
tgggggatgaggacaccag

SEQ ID NO: 8612 - DNA, 19 bp, Artificial Sequence
  Description of Artificial Sequence: Chemically synthesized oligonucleotide
ctggtgtcctcatccccca

SEQ ID NO: 8613 - DNA, 19 bp, Artificial Sequence
  Description of Artificial Sequence: Chemically synthesized oligonucleotide
gggggatgaggacaccagc

SEQ ID NO: 8614 - DNA, 19 bp, Artificial Sequence
  Description of Artificial Sequence: Chemically synthesized oligonucleotide
gctggtgtcctcatccccc

SEQ ID NO: 8615 - DNA, 19 bp, Artificial Sequence
  Description of Artificial Sequence: Chemically synthesized oligonucleotide
ggggatgaggacaccagca

SEQ ID NO: 8616 - DNA, 19 bp, Artificial Sequence
  Description of Artificial Sequence: Chemically synthesized oligonucleotide
tgctggtgtcctcatcccc

SEQ ID NO: 8617 - DNA, 19 bp, Artificial Sequence
  Description of Artificial Sequence: Chemically synthesized oligonucleotide
gggatgaggacaccagcag

SEQ ID NO: 8618 - DNA, 19 bp, Artificial Sequence
  Description of Artificial Sequence: Chemically synthesized oligonucleotide
ctgctggtgtcctcatccc

SEQ ID NO: 8619 - DNA, 19 bp, Artificial Sequence
  Description of Artificial Sequence: Chemically synthesized oligonucleotide
ggatgaggacaccagcagg

SEQ ID NO: 8620 - DNA, 19 bp, Artificial Sequence
  Description of Artificial Sequence: Chemically synthesized oligonucleotide
cctgctggtgtcctcatcc

SEQ ID NO: 8621 - DNA, 19 bp, Artificial Sequence
  Description of Artificial Sequence: Chemically synthesized oligonucleotide
gatgaggacaccagcaggg

SEQ ID NO: 8622 - DNA, 19 bp, Artificial Sequence
  Description of Artificial Sequence: Chemically synthesized oligonucleotide
ccctgctggtgtcctcatc

SEQ ID NO: 8623 - DNA, 19 bp, Artificial Sequence
  Description of Artificial Sequence: Chemically synthesized oligonucleotide
atgaggacaccagcagggt

SEQ ID NO: 8624 - DNA, 19 bp, Artificial Sequence
  Description of Artificial Sequence: Chemically synthesized oligonucleotide
accctgctggtgtcctcat

SEQ ID NO: 8625 - DNA, 19 bp, Artificial Sequence
  Description of Artificial Sequence: Chemically synthesized oligonucleotide
tgaggacaccagcagggtg

SEQ ID NO: 8626 - DNA, 19 bp, Artificial Sequence
  Description of Artificial Sequence: Chemically synthesized oligonucleotide
caccctgctggtgtcctca

SEQ ID NO: 8627 - DNA, 19 bp, Artificial Sequence
  Description of Artificial Sequence: Chemically synthesized oligonucleotide
gaggacaccagcagggtgg

SEQ ID NO: 8628 - DNA, 19 bp, Artificial Sequence
  Description of Artificial Sequence: Chemically synthesized oligonucleotide
ccaccctgctggtgtcctc

SEQ ID NO: 8629 - DNA, 19 bp, Artificial Sequence
  Description of Artificial Sequence: Chemically synthesized oligonucleotide
aggacaccagcagggtgga

SEQ ID NO: 8630 - DNA, 19 bp, Artificial Sequence
  Description of Artificial Sequence: Chemically synthesized oligonucleotide
tccaccctgctggtgtcct

SEQ ID NO: 8631 - DNA, 19 bp, Artificial Sequence
  Description of Artificial Sequence: Chemically synthesized oligonucleotide
ggacaccagcagggtggag

SEQ ID NO: 8632 - DNA, 19 bp, Artificial Sequence
  Description of Artificial Sequence: Chemically synthesized oligonucleotide
ctccaccctgctggtgtcc

SEQ ID NO: 8633 - DNA, 19 bp, Artificial Sequence
  Description of Artificial Sequence: Chemically synthesized oligonucleotide
gacaccagcagggtggaga

SEQ ID NO: 8634 - DNA, 19 bp, Artificial Sequence
  Description of Artificial Sequence: Chemically synthesized oligonucleotide
tctccaccctgctggtgtc

SEQ ID NO: 8635 - DNA, 19 bp, Artificial Sequence
  Description of Artificial Sequence: Chemically synthesized oligonucleotide
acaccagcagggtggagaa

SEQ ID NO: 8636 - DNA, 19 bp, Artificial Sequence
  Description of Artificial Sequence: Chemically synthesized oligonucleotide
ttctccaccctgctggtgt

SEQ ID NO: 8637 - DNA, 19 bp, Artificial Sequence
  Description of Artificial Sequence: Chemically synthesized oligonucleotide
caccagcagggtggagaac

SEQ ID NO: 8638 - DNA, 19 bp, Artificial Sequence
  Description of Artificial Sequence: Chemically synthesized oligonucleotide
gttctccaccctgctggtg

SEQ ID NO: 8639 - DNA, 19 bp, Artificial Sequence
  Description of Artificial Sequence: Chemically synthesized oligonucleotide
accagcagggtggagaacc

SEQ ID NO: 8640 - DNA, 19 bp, Artificial Sequence
  Description of Artificial Sequence: Chemically synthesized oligonucleotide
ggttctccaccctgctggt

SEQ ID NO: 8641 - DNA, 19 bp, Artificial Sequence
  Description of Artificial Sequence: Chemically synthesized oligonucleotide
ccagcagggtggagaacct

SEQ ID NO: 8642 - DNA, 19 bp, Artificial Sequence
  Description of Artificial Sequence: Chemically synthesized oligonucleotide
aggttctccaccctgctgg

SEQ ID NO: 8643 - DNA, 19 bp, Artificial Sequence
  Description of Artificial Sequence: Chemically synthesized oligonucleotide
cagcagggtggagaaccta

SEQ ID NO: 8644 - DNA, 19 bp, Artificial Sequence
  Description of Artificial Sequence: Chemically synthesized oligonucleotide
taggttctccaccctgctg

SEQ ID NO: 8645 - DNA, 19 bp, Artificial Sequence
  Description of Artificial Sequence: Chemically synthesized oligonucleotide
agcagggtggagaacctag

SEQ ID NO: 8646 - DNA, 19 bp, Artificial Sequence
  Description of Artificial Sequence: Chemically synthesized oligonucleotide
ctaggttctccaccctgct

SEQ ID NO: 8647 - DNA, 19 bp, Artificial Sequence
  Description of Artificial Sequence: Chemically synthesized oligonucleotide
gcagggtggagaacctagc

SEQ ID NO: 8648 - DNA, 19 bp, Artificial Sequence
  Description of Artificial Sequence: Chemically synthesized oligonucleotide
gctaggttctccaccctgc

SEQ ID NO: 8649 - DNA, 19 bp, Artificial Sequence
  Description of Artificial Sequence: Chemically synthesized oligonucleotide
cagggtggagaacctagct

SEQ ID NO: 8650 - DNA, 19 bp, Artificial Sequence
  Description of Artificial Sequence: Chemically synthesized oligonucleotide
agctaggttctccaccctg

SEQ ID NO: 8651 - DNA, 19 bp, Artificial Sequence
  Description of Artificial Sequence: Chemically synthesized oligonucleotide
agggtggagaacctagctg

SEQ ID NO: 8652 - DNA, 19 bp, Artificial Sequence
  Description of Artificial Sequence: Chemically synthesized oligonucleotide
cagctaggttctccaccct

SEQ ID NO: 8653 - DNA, 19 bp, Artificial Sequence
  Description of Artificial Sequence: Chemically synthesized oligonucleotide
gggtggagaacctagctgc

SEQ ID NO: 8654 - DNA, 19 bp, Artificial Sequence
  Description of Artificial Sequence: Chemically synthesized oligonucleotide
gcagctaggttctccaccc

SEQ ID NO: 8655 - DNA, 19 bp, Artificial Sequence
  Description of Artificial Sequence: Chemically synthesized oligonucleotide
ggtggagaacctagctgcc

SEQ ID NO: 8656 - DNA, 19 bp, Artificial Sequence
  Description of Artificial Sequence: Chemically synthesized oligonucleotide
ggcagctaggttctccacc

SEQ ID NO: 8657 - DNA, 19 bp, Artificial Sequence
  Description of Artificial Sequence: Chemically synthesized oligonucleotide
gtggagaacctagctgcca

SEQ ID NO: 8658 - DNA, 19 bp, Artificial Sequence
  Description of Artificial Sequence: Chemically synthesized oligonucleotide
tggcagctaggttctccac

SEQ ID NO: 8659 - DNA, 19 bp, Artificial Sequence
  Description of Artificial Sequence: Chemically synthesized oligonucleotide
tggagaacctagctgccag

SEQ ID NO: 8660 - DNA, 19 bp, Artificial Sequence
  Description of Artificial Sequence: Chemically synthesized oligonucleotide
ctggcagctaggttctcca

SEQ ID NO: 8661 - DNA, 19 bp, Artificial Sequence
  Description of Artificial Sequence: Chemically synthesized oligonucleotide
ggagaacctagctgccagt

SEQ ID NO: 8662 - DNA, 19 bp, Artificial Sequence
  Description of Artificial Sequence: Chemically synthesized oligonucleotide
actggcagctaggttctcc

SEQ ID NO: 8663 - DNA, 19 bp, Artificial Sequence
  Description of Artificial Sequence: Chemically synthesized oligonucleotide
gagaacctagctgccagtc

SEQ ID NO: 8664 - DNA, 19 bp, Artificial Sequence
  Description of Artificial Sequence: Chemically synthesized oligonucleotide
gactggcagctaggttctc

SEQ ID NO: 8665 - DNA, 19 bp, Artificial Sequence
  Description of Artificial Sequence: Chemically synthesized oligonucleotide
agaacctagctgccagtct

SEQ ID NO: 8666 - DNA, 19 bp, Artificial Sequence
  Description of Artificial Sequence: Chemically synthesized oligonucleotide
agactggcagctaggttct

SEQ ID NO: 8667 - DNA, 19 bp, Artificial Sequence
  Description of Artificial Sequence: Chemically synthesized oligonucleotide
gaacctagctgccagtctg

SEQ ID NO: 8668 - DNA, 19 bp, Artificial Sequence
  Description of Artificial Sequence: Chemically synthesized oligonucleotide
cagactggcagctaggttc

SEQ ID NO: 8669 - DNA, 19 bp, Artificial Sequence
  Description of Artificial Sequence: Chemically synthesized oligonucleotide
aacctagctgccagtctgc

SEQ ID NO: 8670 - DNA, 19 bp, Artificial Sequence
  Description of Artificial Sequence: Chemically synthesized oligonucleotide
gcagactggcagctaggtt

SEQ ID NO: 8671 - DNA, 19 bp, Artificial Sequence
  Description of Artificial Sequence: Chemically synthesized oligonucleotide
acctagctgccagtctgcc

SEQ ID NO: 8672 - DNA, 19 bp, Artificial Sequence
  Description of Artificial Sequence: Chemically synthesized oligonucleotide
ggcagactggcagctaggt

SEQ ID NO: 8673 - DNA, 19 bp, Artificial Sequence
  Description of Artificial Sequence: Chemically synthesized oligonucleotide
cctagctgccagtctgcca

SEQ ID NO: 8674 - DNA, 19 bp, Artificial Sequence
  Description of Artificial Sequence: Chemically synthesized oligonucleotide
tggcagactggcagctagg

SEQ ID NO: 8675 - DNA, 19 bp, Artificial Sequence
  Description of Artificial Sequence: Chemically synthesized oligonucleotide
ctagctgccagtctgccac

SEQ ID NO: 8676 - DNA, 19 bp, Artificial Sequence
  Description of Artificial Sequence: Chemically synthesized oligonucleotide
gtggcagactggcagctag

SEQ ID NO: 8677 - DNA, 19 bp, Artificial Sequence
  Description of Artificial Sequence: Chemically synthesized oligonucleotide
tagctgccagtctgccact

SEQ ID NO: 8678 - DNA, 19 bp, Artificial Sequence
  Description of Artificial Sequence: Chemically synthesized oligonucleotide
agtggcagactggcagcta

SEQ ID NO: 8679 - DNA, 19 bp, Artificial Sequence
  Description of Artificial Sequence: Chemically synthesized oligonucleotide
agctgccagtctgccactt

SEQ ID NO: 8680 - DNA, 19 bp, Artificial Sequence
  Description of Artificial Sequence: Chemically synthesized oligonucleotide
aagtggcagactggcagct

SEQ ID NO: 8681 - DNA, 19 bp, Artificial Sequence
  Description of Artificial Sequence: Chemically synthesized oligonucleotide
gctgccagtctgccacttc

SEQ ID NO: 8682 - DNA, 19 bp, Artificial Sequence
  Description of Artificial Sequence: Chemically synthesized oligonucleotide
gaagtggcagactggcagc

SEQ ID NO: 8683 - DNA, 19 bp, Artificial Sequence
  Description of Artificial Sequence: Chemically synthesized oligonucleotide
ctgccagtctgccacttcc

SEQ ID NO: 8684 - DNA, 19 bp, Artificial Sequence
  Description of Artificial Sequence: Chemically synthesized oligonucleotide
ggaagtggcagactggcag

SEQ ID NO: 8685 - DNA, 19 bp, Artificial Sequence
  Description of Artificial Sequence: Chemically synthesized oligonucleotide
tgccagtctgccacttccg

SEQ ID NO: 8686 - DNA, 19 bp, Artificial Sequence
  Description of Artificial Sequence: Chemically synthesized oligonucleotide
cggaagtggcagactggca

SEQ ID NO: 8687 - DNA, 19 bp, Artificial Sequence
  Description of Artificial Sequence: Chemically synthesized oligonucleotide
gccagtctgccacttccgg

SEQ ID NO: 8688 - DNA, 19 bp, Artificial Sequence
  Description of Artificial Sequence: Chemically synthesized oligonucleotide
ccggaagtggcagactggc

SEQ ID NO: 8689 - DNA, 19 bp, Artificial Sequence
  Description of Artificial Sequence: Chemically synthesized oligonucleotide
ccagtctgccacttccgga

SEQ ID NO: 8690 - DNA, 19 bp, Artificial Sequence
  Description of Artificial Sequence: Chemically synthesized oligonucleotide
tccggaagtggcagactgg

SEQ ID NO: 8691 - DNA, 19 bp, Artificial Sequence
  Description of Artificial Sequence: Chemically synthesized oligonucleotide
cagtctgccacttccggag

SEQ ID NO: 8692 - DNA, 19 bp, Artificial Sequence
  Description of Artificial Sequence: Chemically synthesized oligonucleotide
ctccggaagtggcagactg

SEQ ID NO: 8693 - DNA, 19 bp, Artificial Sequence
  Description of Artificial Sequence: Chemically synthesized oligonucleotide
agtctgccacttccggagt

SEQ ID NO: 8694 - DNA, 19 bp, Artificial Sequence
  Description of Artificial Sequence: Chemically synthesized oligonucleotide
actccggaagtggcagact

SEQ ID NO: 8695 - DNA, 19 bp, Artificial Sequence
  Description of Artificial Sequence: Chemically synthesized oligonucleotide
gtctgccacttccggagta

SEQ ID NO: 8696 - DNA, 19 bp, Artificial Sequence
  Description of Artificial Sequence: Chemically synthesized oligonucleotide
tactccggaagtggcagac

SEQ ID NO: 8697 - DNA, 19 bp, Artificial Sequence
  Description of Artificial Sequence: Chemically synthesized oligonucleotide
tctgccacttccggagtac

SEQ ID NO: 8698 - DNA, 19 bp, Artificial Sequence
  Description of Artificial Sequence: Chemically synthesized oligonucleotide
gtactccggaagtggcaga

SEQ ID NO: 8699 - DNA, 19 bp, Artificial Sequence
  Description of Artificial Sequence: Chemically synthesized oligonucleotide
ctgccacttccggagtact

SEQ ID NO: 8700 - DNA, 19 bp, Artificial Sequence
  Description of Artificial Sequence: Chemically synthesized oligonucleotide
agtactccggaagtggcag

SEQ ID NO: 8701 - DNA, 19 bp, Artificial Sequence
  Description of Artificial Sequence: Chemically synthesized oligonucleotide
tgccacttccggagtactg

SEQ ID NO: 8702 - DNA, 19 bp, Artificial Sequence
  Description of Artificial Sequence: Chemically synthesized oligonucleotide
cagtactccggaagtggca

SEQ ID NO: 8703 - DNA, 19 bp, Artificial Sequence
  Description of Artificial Sequence: Chemically synthesized oligonucleotide
gccacttccggagtactgc

SEQ ID NO: 8704 - DNA, 19 bp, Artificial Sequence
  Description of Artificial Sequence: Chemically synthesized oligonucleotide
gcagtactccggaagtggc

SEQ ID NO: 8705 - DNA, 19 bp, Artificial Sequence
  Description of Artificial Sequence: Chemically synthesized oligonucleotide
ccacttccggagtactgcg

SEQ ID NO: 8706 - DNA, 19 bp, Artificial Sequence
  Description of Artificial Sequence: Chemically synthesized oligonucleotide
cgcagtactccggaagtgg

SEQ ID NO: 8707 - DNA, 19 bp, Artificial Sequence
  Description of Artificial Sequence: Chemically synthesized oligonucleotide
cacttccggagtactgcgc

SEQ ID NO: 8708 - DNA, 19 bp, Artificial Sequence
  Description of Artificial Sequence: Chemically synthesized oligonucleotide
gcgcagtactccggaagtg

SEQ ID NO: 8709 - DNA, 19 bp, Artificial Sequence
  Description of Artificial Sequence: Chemically synthesized oligonucleotide
acttccggagtactgcgcc

SEQ ID NO: 8710 - DNA, 19 bp, Artificial Sequence
  Description of Artificial Sequence: Chemically synthesized oligonucleotide
ggcgcagtactccggaagt

SEQ ID NO: 8711 - DNA, 19 bp, Artificial Sequence
  Description of Artificial Sequence: Chemically synthesized oligonucleotide
cttccggagtactgcgccc

SEQ ID NO: 8712 - DNA, 19 bp, Artificial Sequence
  Description of Artificial Sequence: Chemically synthesized oligonucleotide
gggcgcagtactccggaag

SEQ ID NO: 8713 - DNA, 19 bp, Artificial Sequence
  Description of Artificial Sequence: Chemically synthesized oligonucleotide
ttccggagtactgcgccct

SEQ ID NO: 8714 - DNA, 19 bp, Artificial Sequence
  Description of Artificial Sequence: Chemically synthesized oligonucleotide
agggcgcagtactccggaa

SEQ ID NO: 8715 - DNA, 19 bp, Artificial Sequence
  Description of Artificial Sequence: Chemically synthesized oligonucleotide
tccggagtactgcgccctc

SEQ ID NO: 8716 - DNA, 19 bp, Artificial Sequence
  Description of Artificial Sequence: Chemically synthesized oligonucleotide
gagggcgcagtactccgga

SEQ ID NO: 8717 - DNA, 19 bp, Artificial Sequence
  Description of Artificial Sequence: Chemically synthesized oligonucleotide
ccggagtactgcgccctcc

SEQ ID NO: 8718 - DNA, 19 bp, Artificial Sequence
  Description of Artificial Sequence: Chemically synthesized oligonucleotide
ggagggcgcagtactccgg

SEQ ID NO: 8719 - DNA, 19 bp, Artificial Sequence
  Description of Artificial Sequence: Chemically synthesized oligonucleotide
cggagtactgcgccctcca

SEQ ID NO: 8720 - DNA, 19 bp, Artificial Sequence
  Description of Artificial Sequence: Chemically synthesized oligonucleotide
tggagggcgcagtactccg

SEQ ID NO: 8721 - DNA, 19 bp, Artificial Sequence
  Description of Artificial Sequence: Chemically synthesized oligonucleotide
ggagtactgcgccctccat

SEQ ID NO: 8722 - DNA, 19 bp, Artificial Sequence
  Description of Artificial Sequence: Chemically synthesized oligonucleotide
atggagggcgcagtactcc

SEQ ID NO: 8723 - DNA, 19 bp, Artificial Sequence
  Description of Artificial Sequence: Chemically synthesized oligonucleotide
gagtactgcgccctccatg

SEQ ID NO: 8724 - DNA, 19 bp, Artificial Sequence
  Description of Artificial Sequence: Chemically synthesized oligonucleotide
catggagggcgcagtactc

SEQ ID NO: 8725 - DNA, 19 bp, Artificial Sequence
  Description of Artificial Sequence: Chemically synthesized oligonucleotide
agtactgcgccctccatgg

SEQ ID NO: 8726 - DNA, 19 bp, Artificial Sequence
  Description of Artificial Sequence: Chemically synthesized oligonucleotide
ccatggagggcgcagtact

SEQ ID NO: 8727 - DNA, 19 bp, Artificial Sequence
  Description of Artificial Sequence: Chemically synthesized oligonucleotide
gtactgcgccctccatgga

SEQ ID NO: 8728 - DNA, 19 bp, Artificial Sequence
  Description of Artificial Sequence: Chemically synthesized oligonucleotide
tccatggagggcgcagtac

SEQ ID NO: 8729 - DNA, 19 bp, Artificial Sequence
  Description of Artificial Sequence: Chemically synthesized oligonucleotide
tactgcgccctccatggaa

SEQ ID NO: 8730 - DNA, 19 bp, Artificial Sequence
  Description of Artificial Sequence: Chemically synthesized oligonucleotide
ttccatggagggcgcagta

SEQ ID NO: 8731 - DNA, 19 bp, Artificial Sequence
  Description of Artificial Sequence: Chemically synthesized oligonucleotide
actgcgccctccatggaaa

SEQ ID NO: 8732 - DNA, 19 bp, Artificial Sequence
  Description of Artificial Sequence: Chemically synthesized oligonucleotide
tttccatggagggcgcagt

SEQ ID NO: 8733 - DNA, 19 bp, Artificial Sequence
  Description of Artificial Sequence: Chemically synthesized oligonucleotide
ctgcgccctccatggaaaa

SEQ ID NO: 8734 - DNA, 19 bp, Artificial Sequence
  Description of Artificial Sequence: Chemically synthesized oligonucleotide
ttttccatggagggcgcag

SEQ ID NO: 8735 - DNA, 19 bp, Artificial Sequence
  Description of Artificial Sequence: Chemically synthesized oligonucleotide
tgcgccctccatggaaaac

SEQ ID NO: 8736 - DNA, 19 bp, Artificial Sequence
  Description of Artificial Sequence: Chemically synthesized oligonucleotide
gttttccatggagggcgca

SEQ ID NO: 8737 - DNA, 19 bp, Artificial Sequence
  Description of Artificial Sequence: Chemically synthesized oligonucleotide
gcgccctccatggaaaact

SEQ ID NO: 8738 - DNA, 19 bp, Artificial Sequence
  Description of Artificial Sequence: Chemically synthesized oligonucleotide
agttttccatggagggcgc

SEQ ID NO: 8739 - DNA, 19 bp, Artificial Sequence
  Description of Artificial Sequence: Chemically synthesized oligonucleotide
cgccctccatggaaaactc

SEQ ID NO: 8740 - DNA, 19 bp, Artificial Sequence
  Description of Artificial Sequence: Chemically synthesized oligonucleotide
gagttttccatggagggcg

SEQ ID NO: 8741 - DNA, 19 bp, Artificial Sequence
  Description of Artificial Sequence: Chemically synthesized oligonucleotide
gccctccatggaaaactca

SEQ ID NO: 8742 - DNA, 19 bp, Artificial Sequence
  Description of Artificial Sequence: Chemically synthesized oligonucleotide
tgagttttccatggagggc

SEQ ID NO: 8743 - DNA, 19 bp, Artificial Sequence
  Description of Artificial Sequence: Chemically synthesized oligonucleotide
ccctccatggaaaactcaa

SEQ ID NO: 8744 - DNA, 19 bp, Artificial Sequence
  Description of Artificial Sequence: Chemically synthesized oligonucleotide
ttgagttttccatggaggg

SEQ ID NO: 8745 - DNA, 19 bp, Artificial Sequence
  Description of Artificial Sequence: Chemically synthesized oligonucleotide
cctccatggaaaactcaac

SEQ ID NO: 8746 - DNA, 19 bp, Artificial Sequence
  Description of Artificial Sequence: Chemically synthesized oligonucleotide
gttgagttttccatggagg

SEQ ID NO: 8747 - DNA, 19 bp, Artificial Sequence
  Description of Artificial Sequence: Chemically synthesized oligonucleotide
ctccatggaaaactcaacc

SEQ ID NO: 8748 - DNA, 19 bp, Artificial Sequence
  Description of Artificial Sequence: Chemically synthesized oligonucleotide
ggttgagttttccatggag

SEQ ID NO: 8749 - DNA, 19 bp, Artificial Sequence
  Description of Artificial Sequence: Chemically synthesized oligonucleotide
tccatggaaaactcaacct

SEQ ID NO: 8750 - DNA, 19 bp, Artificial Sequence
  Description of Artificial Sequence: Chemically synthesized oligonucleotide
aggttgagttttccatgga

SEQ ID NO: 8751 - DNA, 19 bp, Artificial Sequence
  Description of Artificial Sequence: Chemically synthesized oligonucleotide
ccatggaaaactcaacctg

SEQ ID NO: 8752 - DNA, 19 bp, Artificial Sequence
  Description of Artificial Sequence: Chemically synthesized oligonucleotide
caggttgagttttccatgg

SEQ ID NO: 8753 - DNA, 19 bp, Artificial Sequence
  Description of Artificial Sequence: Chemically synthesized oligonucleotide
catggaaaactcaacctgg

SEQ ID NO: 8754 - DNA, 19 bp, Artificial Sequence
  Description of Artificial Sequence: Chemically synthesized oligonucleotide
ccaggttgagttttccatg

SEQ ID NO: 8755 - DNA, 19 bp, Artificial Sequence
  Description of Artificial Sequence: Chemically synthesized oligonucleotide
atggaaaactcaacctggc

SEQ ID NO: 8756 - DNA, 19 bp, Artificial Sequence
  Description of Artificial Sequence: Chemically synthesized oligonucleotide
gccaggttgagttttccat

SEQ ID NO: 8757 - DNA, 19 bp, Artificial Sequence
  Description of Artificial Sequence: Chemically synthesized oligonucleotide
tggaaaactcaacctggct

SEQ ID NO: 8758 - DNA, 19 bp, Artificial Sequence
  Description of Artificial Sequence: Chemically synthesized oligonucleotide
agccaggttgagttttcca

SEQ ID NO: 8759 - DNA, 19 bp, Artificial Sequence
  Description of Artificial Sequence: Chemically synthesized oligonucleotide
ggaaaactcaacctggctt

SEQ ID NO: 8760 - DNA, 19 bp, Artificial Sequence
  Description of Artificial Sequence: Chemically synthesized oligonucleotide
aagccaggttgagttttcc

SEQ ID NO: 8761 - DNA, 19 bp, Artificial Sequence
  Description of Artificial Sequence: Chemically synthesized oligonucleotide
gaaaactcaacctggcttc

SEQ ID NO: 8762 - DNA, 19 bp, Artificial Sequence
  Description of Artificial Sequence: Chemically synthesized oligonucleotide
gaagccaggttgagttttc

SEQ ID NO: 8763 - DNA, 19 bp, Artificial Sequence
  Description of Artificial Sequence: Chemically synthesized oligonucleotide
aaaactcaacctggcttcc

SEQ ID NO: 8764 - DNA, 19 bp, Artificial Sequence
  Description of Artificial Sequence: Chemically synthesized oligonucleotide
ggaagccaggttgagtttt

SEQ ID NO: 8765 - DNA, 19 bp, Artificial Sequence
  Description of Artificial Sequence: Chemically synthesized oligonucleotide
aaactcaacctggcttcct

SEQ ID NO: 8766 - DNA, 19 bp, Artificial Sequence
  Description of Artificial Sequence: Chemically synthesized oligonucleotide
aggaagccaggttgagttt

SEQ ID NO: 8767 - DNA, 19 bp, Artificial Sequence
  Description of Artificial Sequence: Chemically synthesized oligonucleotide
aactcaacctggcttccta

SEQ ID NO: 8768 - DNA, 19 bp, Artificial Sequence
  Description of Artificial Sequence: Chemically synthesized oligonucleotide
taggaagccaggttgagtt

SEQ ID NO: 8769 - DNA, 19 bp, Artificial Sequence
  Description of Artificial Sequence: Chemically synthesized oligonucleotide
actcaacctggcttcctac

SEQ ID NO: 8770 - DNA, 19 bp, Artificial Sequence
  Description of Artificial Sequence: Chemically synthesized oligonucleotide
gtaggaagccaggttgagt

SEQ ID NO: 8771 - DNA, 19 bp, Artificial Sequence
  Description of Artificial Sequence: Chemically synthesized oligonucleotide
ctcaacctggcttcctacc

SEQ ID NO: 8772 - DNA, 19 bp, Artificial Sequence
  Description of Artificial Sequence: Chemically synthesized oligonucleotide
ggtaggaagccaggttgag

SEQ ID NO: 8773 - DNA, 19 bp, Artificial Sequence
  Description of Artificial Sequence: Chemically synthesized oligonucleotide
tcaacctggcttcctacct

SEQ ID NO: 8774 - DNA, 19 bp, Artificial Sequence
  Description of Artificial Sequence: Chemically synthesized oligonucleotide
aggtaggaagccaggttga

SEQ ID NO: 8775 - DNA, 19 bp, Artificial Sequence
  Description of Artificial Sequence: Chemically synthesized oligonucleotide
caacctggcttcctacctc

SEQ ID NO: 8776 - DNA, 19 bp, Artificial Sequence
  Description of Artificial Sequence: Chemically synthesized oligonucleotide
gaggtaggaagccaggttg

SEQ ID NO: 8777 - DNA, 19 bp, Artificial Sequence
  Description of Artificial Sequence: Chemically synthesized oligonucleotide
aacctggcttcctacctcc

SEQ ID NO: 8778 - DNA, 19 bp, Artificial Sequence
  Description of Artificial Sequence: Chemically synthesized oligonucleotide
ggaggtaggaagccaggtt

SEQ ID NO: 8779 - DNA, 19 bp, Artificial Sequence
  Description of Artificial Sequence: Chemically synthesized oligonucleotide
acctggcttcctacctccc

SEQ ID NO: 8780 - DNA, 19 bp, Artificial Sequence
  Description of Artificial Sequence: Chemically synthesized oligonucleotide
gggaggtaggaagccaggt

SEQ ID NO: 8781 - DNA, 19 bp, Artificial Sequence
  Description of Artificial Sequence: Chemically synthesized oligonucleotide
cctggcttcctacctccca

SEQ ID NO: 8782 - DNA, 19 bp, Artificial Sequence
  Description of Artificial Sequence: Chemically synthesized oligonucleotide
tgggaggtaggaagccagg

SEQ ID NO: 8783 - DNA, 19 bp, Artificial Sequence
  Description of Artificial Sequence: Chemically synthesized oligonucleotide
ctggcttcctacctcccac

SEQ ID NO: 8784 - DNA, 19 bp, Artificial Sequence
  Description of Artificial Sequence: Chemically synthesized oligonucleotide
gtgggaggtaggaagccag

SEQ ID NO: 8785 - DNA, 19 bp, Artificial Sequence
  Description of Artificial Sequence: Chemically synthesized oligonucleotide
tggcttcctacctcccacc

SEQ ID NO: 8786 - DNA, 19 bp, Artificial Sequence
  Description of Artificial Sequence: Chemically synthesized oligonucleotide
ggtgggaggtaggaagcca

SEQ ID NO: 8787 - DNA, 19 bp, Artificial Sequence
  Description of Artificial Sequence: Chemically synthesized oligonucleotide
ggcttcctacctcccaccg

SEQ ID NO: 8788 - DNA, 19 bp, Artificial Sequence
  Description of Artificial Sequence: Chemically synthesized oligonucleotide
cggtgggaggtaggaagcc

SEQ ID NO: 8789 - DNA, 19 bp, Artificial Sequence
  Description of Artificial Sequence: Chemically synthesized oligonucleotide
gcttcctacctcccaccgg

SEQ ID NO: 8790 - DNA, 19 bp, Artificial Sequence
  Description of Artificial Sequence: Chemically synthesized oligonucleotide
ccggtgggaggtaggaagc

SEQ ID NO: 8791 - DNA, 19 bp, Artificial Sequence
  Description of Artificial Sequence: Chemically synthesized oligonucleotide
cttcctacctcccaccggg

SEQ ID NO: 8792 - DNA, 19 bp, Artificial Sequence
  Description of Artificial Sequence: Chemically synthesized oligonucleotide
cccggtgggaggtaggaag

SEQ ID NO: 8793 - DNA, 19 bp, Artificial Sequence
  Description of Artificial Sequence: Chemically synthesized oligonucleotide
ttcctacctcccaccgggc

SEQ ID NO: 8794 - DNA, 19 bp, Artificial Sequence
  Description of Artificial Sequence: Chemically synthesized oligonucleotide
gcccggtgggaggtaggaa

SEQ ID NO: 8795 - DNA, 19 bp, Artificial Sequence
  Description of Artificial Sequence: Chemically synthesized oligonucleotide
tcctacctcccaccgggcc

SEQ ID NO: 8796 - DNA, 19 bp, Artificial Sequence
  Description of Artificial Sequence: Chemically synthesized oligonucleotide
ggcccggtgggaggtagga

SEQ ID NO: 8797 - DNA, 19 bp, Artificial Sequence
  Description of Artificial Sequence: Chemically synthesized oligonucleotide
cctacctcccaccgggcct

SEQ ID NO: 8798 - DNA, 19 bp, Artificial Sequence
  Description of Artificial Sequence: Chemically synthesized oligonucleotide
aggcccggtgggaggtagg

SEQ ID NO: 8799 - DNA, 19 bp, Artificial Sequence
  Description of Artificial Sequence: Chemically synthesized oligonucleotide
ctacctcccaccgggcctt

SEQ ID NO: 8800 - DNA, 19 bp, Artificial Sequence
  Description of Artificial Sequence: Chemically synthesized oligonucleotide
aaggcccggtgggaggtag

SEQ ID NO: 8801 - DNA, 19 bp, Artificial Sequence
  Description of Artificial Sequence: Chemically synthesized oligonucleotide
tacctcccaccgggccttg

SEQ ID NO: 8802 - DNA, 19 bp, Artificial Sequence
  Description of Artificial Sequence: Chemically synthesized oligonucleotide
caaggcccggtgggaggta

SEQ ID NO: 8803 - DNA, 19 bp, Artificial Sequence
  Description of Artificial Sequence: Chemically synthesized oligonucleotide
acctcccaccgggccttgc

SEQ ID NO: 8804 - DNA, 19 bp, Artificial Sequence
  Description of Artificial Sequence: Chemically synthesized oligonucleotide
gcaaggcccggtgggaggt

SEQ ID NO: 8805 - DNA, 19 bp, Artificial Sequence
  Description of Artificial Sequence: Chemically synthesized oligonucleotide
cctcccaccgggccttgcc

SEQ ID NO: 8806 - DNA, 19 bp, Artificial Sequence
  Description of Artificial Sequence: Chemically synthesized oligonucleotide
ggcaaggcccggtgggagg

SEQ ID NO: 8807 - DNA, 19 bp, Artificial Sequence
  Description of Artificial Sequence: Chemically synthesized oligonucleotide
ctcccaccgggccttgccc

SEQ ID NO: 8808 - DNA, 19 bp, Artificial Sequence
  Description of Artificial Sequence: Chemically synthesized oligonucleotide
gggcaaggcccggtgggag

SEQ ID NO: 8809 - DNA, 19 bp, Artificial Sequence
  Description of Artificial Sequence: Chemically synthesized oligonucleotide
tcccaccgggccttgccct

SEQ ID NO: 8810 - DNA, 19 bp, Artificial Sequence
  Description of Artificial Sequence: Chemically synthesized oligonucleotide
agggcaaggcccggtggga

SEQ ID NO: 8811 - DNA, 19 bp, Artificial Sequence
  Description of Artificial Sequence: Chemically synthesized oligonucleotide
cccaccgggccttgccctg

SEQ ID NO: 8812 - DNA, 19 bp, Artificial Sequence
  Description of Artificial Sequence: Chemically synthesized oligonucleotide
cagggcaaggcccggtggg

SEQ ID NO: 8813 - DNA, 19 bp, Artificial Sequence
  Description of Artificial Sequence: Chemically synthesized oligonucleotide
ccaccgggccttgccctgc

SEQ ID NO: 8814 - DNA, 19 bp, Artificial Sequence
  Description of Artificial Sequence: Chemically synthesized oligonucleotide
gcagggcaaggcccggtgg

SEQ ID NO: 8815 - DNA, 19 bp, Artificial Sequence
  Description of Artificial Sequence: Chemically synthesized oligonucleotide
caccgggccttgccctgcg

SEQ ID NO: 8816 - DNA, 19 bp, Artificial Sequence
  Description of Artificial Sequence: Chemically synthesized oligonucleotide
cgcagggcaaggcccggtg

SEQ ID NO: 8817 - DNA, 19 bp, Artificial Sequence
  Description of Artificial Sequence: Chemically synthesized oligonucleotide
accgggccttgccctgcgt

SEQ ID NO: 8818 - DNA, 19 bp, Artificial Sequence
  Description of Artificial Sequence: Chemically synthesized oligonucleotide
acgcagggcaaggcccggt

SEQ ID NO: 8819 - DNA, 19 bp, Artificial Sequence
  Description of Artificial Sequence: Chemically synthesized oligonucleotide
ccgggccttgccctgcgtc

SEQ ID NO: 8820 - DNA, 19 bp, Artificial Sequence
  Description of Artificial Sequence: Chemically synthesized oligonucleotide
gacgcagggcaaggcccgg

SEQ ID NO: 8821 - DNA, 19 bp, Artificial Sequence
  Description of Artificial Sequence: Chemically synthesized oligonucleotide
cgggccttgccctgcgtcc

SEQ ID NO: 8822 - DNA, 19 bp, Artificial Sequence
  Description of Artificial Sequence: Chemically synthesized oligonucleotide
ggacgcagggcaaggcccg

SEQ ID NO: 8823 - DNA, 19 bp, Artificial Sequence
  Description of Artificial Sequence: Chemically synthesized oligonucleotide
gggccttgccctgcgtcca

SEQ ID NO: 8824 - DNA, 19 bp, Artificial Sequence
  Description of Artificial Sequence: Chemically synthesized oligonucleotide
tggacgcagggcaaggccc

SEQ ID NO: 8825 - DNA, 19 bp, Artificial Sequence
  Description of Artificial Sequence: Chemically synthesized oligonucleotide
ggccttgccctgcgtccac

SEQ ID NO: 8826 - DNA, 19 bp, Artificial Sequence
  Description of Artificial Sequence: Chemically synthesized oligonucleotide
gtggacgcagggcaaggcc

SEQ ID NO: 8827 - DNA, 19 bp, Artificial Sequence
  Description of Artificial Sequence: Chemically synthesized oligonucleotide
gccttgccctgcgtccact

SEQ ID NO: 8828 - DNA, 19 bp, Artificial Sequence
  Description of Artificial Sequence: Chemically synthesized oligonucleotide
agtggacgcagggcaaggc

SEQ ID NO: 8829 - DNA, 19 bp, Artificial Sequence
  Description of Artificial Sequence: Chemically synthesized oligonucleotide
ccttgccctgcgtccactg

SEQ ID NO: 8830 - DNA, 19 bp, Artificial Sequence
  Description of Artificial Sequence: Chemically synthesized oligonucleotide
cagtggacgcagggcaagg

SEQ ID NO: 8831 - DNA, 19 bp, Artificial Sequence
  Description of Artificial Sequence: Chemically synthesized oligonucleotide
cttgccctgcgtccactgg

SEQ ID NO: 8832 - DNA, 19 bp, Artificial Sequence
  Description of Artificial Sequence: Chemically synthesized oligonucleotide
ccagtggacgcagggcaag

SEQ ID NO: 8833 - DNA, 19 bp, Artificial Sequence
  Description of Artificial Sequence: Chemically synthesized oligonucleotide
ttgccctgcgtccactgga

SEQ ID NO: 8834 - DNA, 19 bp, Artificial Sequence
  Description of Artificial Sequence: Chemically synthesized oligonucleotide
tccagtggacgcagggcaa

SEQ ID NO: 8835 - DNA, 19 bp, Artificial Sequence
  Description of Artificial Sequence: Chemically synthesized oligonucleotide
tgccctgcgtccactggag

SEQ ID NO: 8836 - DNA, 19 bp, Artificial Sequence
  Description of Artificial Sequence: Chemically synthesized oligonucleotide
ctccagtggacgcagggca

SEQ ID NO: 8837 - DNA, 19 bp, Artificial Sequence
  Description of Artificial Sequence: Chemically synthesized oligonucleotide
gccctgcgtccactggagc

SEQ ID NO: 8838 - DNA, 19 bp, Artificial Sequence
  Description of Artificial Sequence: Chemically synthesized oligonucleotide
gctccagtggacgcagggc

SEQ ID NO: 8839 - DNA, 19 bp, Artificial Sequence
  Description of Artificial Sequence: Chemically synthesized oligonucleotide
ccctgcgtccactggagcc

SEQ ID NO: 8840 - DNA, 19 bp, Artificial Sequence
  Description of Artificial Sequence: Chemically synthesized oligonucleotide
ggctccagtggacgcaggg

SEQ ID NO: 8841 - DNA, 19 bp, Artificial Sequence
  Description of Artificial Sequence: Chemically synthesized oligonucleotide
cctgcgtccactggagccc

SEQ ID NO: 8842 - DNA, 19 bp, Artificial Sequence
  Description of Artificial Sequence: Chemically synthesized oligonucleotide
gggctccagtggacgcagg

SEQ ID NO: 8843 - DNA, 19 bp, Artificial Sequence
  Description of Artificial Sequence: Chemically synthesized oligonucleotide
ctgcgtccactggagcccc

SEQ ID NO: 8844 - DNA, 19 bp, Artificial Sequence
  Description of Artificial Sequence: Chemically synthesized oligonucleotide
ggggctccagtggacgcag

SEQ ID NO: 8845 - DNA, 19 bp, Artificial Sequence
  Description of Artificial Sequence: Chemically synthesized oligonucleotide
tgcgtccactggagcccca

SEQ ID NO: 8846 - DNA, 19 bp, Artificial Sequence
  Description of Artificial Sequence: Chemically synthesized oligonucleotide
tggggctccagtggacgca

SEQ ID NO: 8847 - DNA, 19 bp, Artificial Sequence
  Description of Artificial Sequence: Chemically synthesized oligonucleotide
gcgtccactggagccccag

SEQ ID NO: 8848 - DNA, 19 bp, Artificial Sequence
  Description of Artificial Sequence: Chemically synthesized oligonucleotide
ctggggctccagtggacgc

SEQ ID NO: 8849 - DNA, 19 bp, Artificial Sequence
  Description of Artificial Sequence: Chemically synthesized oligonucleotide
cgtccactggagccccagc

SEQ ID NO: 8850 - DNA, 19 bp, Artificial Sequence
  Description of Artificial Sequence: Chemically synthesized oligonucleotide
gctggggctccagtggacg

SEQ ID NO: 8851 - DNA, 19 bp, Artificial Sequence
  Description of Artificial Sequence: Chemically synthesized oligonucleotide
gtccactggagccccagct

SEQ ID NO: 8852 - DNA, 19 bp, Artificial Sequence
  Description of Artificial Sequence: Chemically synthesized oligonucleotide
agctggggctccagtggac

SEQ ID NO: 8853 - DNA, 19 bp, Artificial Sequence
  Description of Artificial Sequence: Chemically synthesized oligonucleotide
tccactggagccccagctc

SEQ ID NO: 8854 - DNA, 19 bp, Artificial Sequence
  Description of Artificial Sequence: Chemically synthesized oligonucleotide
gagctggggctccagtgga

SEQ ID NO: 8855 - DNA, 19 bp, Artificial Sequence
  Description of Artificial Sequence: Chemically synthesized oligonucleotide
ccactggagccccagctct

SEQ ID NO: 8856 - DNA, 19 bp, Artificial Sequence
  Description of Artificial Sequence: Chemically synthesized oligonucleotide
agagctggggctccagtgg

SEQ ID NO: 8857 - DNA, 19 bp, Artificial Sequence
  Description of Artificial Sequence: Chemically synthesized oligonucleotide
cactggagccccagctctg

SEQ ID NO: 8858 - DNA, 19 bp, Artificial Sequence
  Description of Artificial Sequence: Chemically synthesized oligonucleotide
cagagctggggctccagtg

SEQ ID NO: 8859 - DNA, 19 bp, Artificial Sequence
  Description of Artificial Sequence: Chemically synthesized oligonucleotide
actggagccccagctctgg

SEQ ID NO: 8860 - DNA, 19 bp, Artificial Sequence
  Description of Artificial Sequence: Chemically synthesized oligonucleotide
ccagagctggggctccagt

SEQ ID NO: 8861 - DNA, 19 bp, Artificial Sequence
  Description of Artificial Sequence: Chemically synthesized oligonucleotide
ctggagccccagctctggg

SEQ ID NO: 8862 - DNA, 19 bp, Artificial Sequence
  Description of Artificial Sequence: Chemically synthesized oligonucleotide
cccagagctggggctccag

SEQ ID NO: 8863 - DNA, 19 bp, Artificial Sequence
  Description of Artificial Sequence: Chemically synthesized oligonucleotide
tggagccccagctctgggc

SEQ ID NO: 8864 - DNA, 19 bp, Artificial Sequence
  Description of Artificial Sequence: Chemically synthesized oligonucleotide
gcccagagctggggctcca

SEQ ID NO: 8865 - DNA, 19 bp, Artificial Sequence
  Description of Artificial Sequence: Chemically synthesized oligonucleotide
ggagccccagctctgggca

SEQ ID NO: 8866 - DNA, 19 bp, Artificial Sequence
  Description of Artificial Sequence: Chemically synthesized oligonucleotide
tgcccagagctggggctcc

SEQ ID NO: 8867 - DNA, 19 bp, Artificial Sequence
  Description of Artificial Sequence: Chemically synthesized oligonucleotide
gagccccagctctgggcag

SEQ ID NO: 8868 - DNA, 19 bp, Artificial Sequence
  Description of Artificial Sequence: Chemically synthesized oligonucleotide
ctgcccagagctggggctc

SEQ ID NO: 8869 - DNA, 19 bp, Artificial Sequence
  Description of Artificial Sequence: Chemically synthesized oligonucleotide
agccccagctctgggcagc

SEQ ID NO: 8870 - DNA, 19 bp, Artificial Sequence
  Description of Artificial Sequence: Chemically synthesized oligonucleotide
gctgcccagagctggggct

SEQ ID NO: 8871 - DNA, 19 bp, Artificial Sequence
  Description of Artificial Sequence: Chemically synthesized oligonucleotide
gccccagctctgggcagcc

SEQ ID NO: 8872 - DNA, 19 bp, Artificial Sequence
  Description of Artificial Sequence: Chemically synthesized oligonucleotide
ggctgcccagagctggggc

SEQ ID NO: 8873 - DNA, 19 bp, Artificial Sequence
  Description of Artificial Sequence: Chemically synthesized oligonucleotide
ccccagctctgggcagcct

SEQ ID NO: 8874 - DNA, 19 bp, Artificial Sequence
  Description of Artificial Sequence: Chemically synthesized oligonucleotide
aggctgcccagagctgggg

SEQ ID NO: 8875 - DNA, 19 bp, Artificial Sequence
  Description of Artificial Sequence: Chemically synthesized oligonucleotide
cccagctctgggcagccta

SEQ ID NO: 8876 - DNA, 19 bp, Artificial Sequence
  Description of Artificial Sequence: Chemically synthesized oligonucleotide
taggctgcccagagctggg

SEQ ID NO: 8877 - DNA, 19 bp, Artificial Sequence
  Description of Artificial Sequence: Chemically synthesized oligonucleotide
ccagctctgggcagcctat

SEQ ID NO: 8878 - DNA, 19 bp, Artificial Sequence
  Description of Artificial Sequence: Chemically synthesized oligonucleotide
ataggctgcccagagctgg

SEQ ID NO: 8879 - DNA, 19 bp, Artificial Sequence
  Description of Artificial Sequence: Chemically synthesized oligonucleotide
cagctctgggcagcctatg

SEQ ID NO: 8880 - DNA, 19 bp, Artificial Sequence
  Description of Artificial Sequence: Chemically synthesized oligonucleotide
cataggctgcccagagctg

SEQ ID NO: 8881 - DNA, 19 bp, Artificial Sequence
  Description of Artificial Sequence: Chemically synthesized oligonucleotide
agctctgggcagcctatgg

SEQ ID NO: 8882 - DNA, 19 bp, Artificial Sequence
  Description of Artificial Sequence: Chemically synthesized oligonucleotide
ccataggctgcccagagct

SEQ ID NO: 8883 - DNA, 19 bp, Artificial Sequence
  Description of Artificial Sequence: Chemically synthesized oligonucleotide
gctctgggcagcctatggt

SEQ ID NO: 8884 - DNA, 19 bp, Artificial Sequence
  Description of Artificial Sequence: Chemically synthesized oligonucleotide
accataggctgcccagagc

SEQ ID NO: 8885 - DNA, 19 bp, Artificial Sequence
  Description of Artificial Sequence: Chemically synthesized oligonucleotide
ctctgggcagcctatggtg

SEQ ID NO: 8886 - DNA, 19 bp, Artificial Sequence
  Description of Artificial Sequence: Chemically synthesized oligonucleotide
caccataggctgcccagag

SEQ ID NO: 8887 - DNA, 19 bp, Artificial Sequence
  Description of Artificial Sequence: Chemically synthesized oligonucleotide
tctgggcagcctatggtgt

SEQ ID NO: 8888 - DNA, 19 bp, Artificial Sequence
  Description of Artificial Sequence: Chemically synthesized oligonucleotide
acaccataggctgcccaga

SEQ ID NO: 8889 - DNA, 19 bp, Artificial Sequence
  Description of Artificial Sequence: Chemically synthesized oligonucleotide
ctgggcagcctatggtgtg

SEQ ID NO: 8890 - DNA, 19 bp, Artificial Sequence
  Description of Artificial Sequence: Chemically synthesized oligonucleotide
cacaccataggctgcccag

SEQ ID NO: 8891 - DNA, 19 bp, Artificial Sequence
  Description of Artificial Sequence: Chemically synthesized oligonucleotide
tgggcagcctatggtgtga

SEQ ID NO: 8892 - DNA, 19 bp, Artificial Sequence
  Description of Artificial Sequence: Chemically synthesized oligonucleotide
tcacaccataggctgccca

SEQ ID NO: 8893 - DNA, 19 bp, Artificial Sequence
  Description of Artificial Sequence: Chemically synthesized oligonucleotide
gggcagcctatggtgtgag

SEQ ID NO: 8894 - DNA, 19 bp, Artificial Sequence
  Description of Artificial Sequence: Chemically synthesized oligonucleotide
ctcacaccataggctgccc

SEQ ID NO: 8895 - DNA, 19 bp, Artificial Sequence
  Description of Artificial Sequence: Chemically synthesized oligonucleotide
ggcagcctatggtgtgagc

SEQ ID NO: 8896 - DNA, 19 bp, Artificial Sequence
  Description of Artificial Sequence: Chemically synthesized oligonucleotide
gctcacaccataggctgcc

SEQ ID NO: 8897 - DNA, 19 bp, Artificial Sequence
  Description of Artificial Sequence: Chemically synthesized oligonucleotide
gcagcctatggtgtgagcc

SEQ ID NO: 8898 - DNA, 19 bp, Artificial Sequence
  Description of Artificial Sequence: Chemically synthesized oligonucleotide
ggctcacaccataggctgc

SEQ ID NO: 8899 - DNA, 19 bp, Artificial Sequence
  Description of Artificial Sequence: Chemically synthesized oligonucleotide
cagcctatggtgtgagccc

SEQ ID NO: 8900 - DNA, 19 bp, Artificial Sequence
  Description of Artificial Sequence: Chemically synthesized oligonucleotide
gggctcacaccataggctg

SEQ ID NO: 8901 - DNA, 19 bp, Artificial Sequence
  Description of Artificial Sequence: Chemically synthesized oligonucleotide
agcctatggtgtgagcccg

SEQ ID NO: 8902 - DNA, 19 bp, Artificial Sequence
  Description of Artificial Sequence: Chemically synthesized oligonucleotide
cgggctcacaccataggct

SEQ ID NO: 8903 - DNA, 19 bp, Artificial Sequence
  Description of Artificial Sequence: Chemically synthesized oligonucleotide
gcctatggtgtgagcccgc

SEQ ID NO: 8904 - DNA, 19 bp, Artificial Sequence
  Description of Artificial Sequence: Chemically synthesized oligonucleotide
gcgggctcacaccataggc

SEQ ID NO: 8905 - DNA, 19 bp, Artificial Sequence
  Description of Artificial Sequence: Chemically synthesized oligonucleotide
cctatggtgtgagcccgca

SEQ ID NO: 8906 - DNA, 19 bp, Artificial Sequence
  Description of Artificial Sequence: Chemically synthesized oligonucleotide
tgcgggctcacaccatagg

SEQ ID NO: 8907 - DNA, 19 bp, Artificial Sequence
  Description of Artificial Sequence: Chemically synthesized oligonucleotide
ctatggtgtgagcccgcac

SEQ ID NO: 8908 - DNA, 19 bp, Artificial Sequence
  Description of Artificial Sequence: Chemically synthesized oligonucleotide
gtgcgggctcacaccatag

SEQ ID NO: 8909 - DNA, 19 bp, Artificial Sequence
  Description of Artificial Sequence: Chemically synthesized oligonucleotide
tatggtgtgagcccgcacc

SEQ ID NO: 8910 - DNA, 19 bp, Artificial Sequence
  Description of Artificial Sequence: Chemically synthesized oligonucleotide
ggtgcgggctcacaccata

SEQ ID NO: 8911 - DNA, 19 bp, Artificial Sequence
  Description of Artificial Sequence: Chemically synthesized oligonucleotide
atggtgtgagcccgcaccg

SEQ ID NO: 8912 - DNA, 19 bp, Artificial Sequence
  Description of Artificial Sequence: Chemically synthesized oligonucleotide
cggtgcgggctcacaccat

SEQ ID NO: 8913 - DNA, 19 bp, Artificial Sequence
  Description of Artificial Sequence: Chemically synthesized oligonucleotide
tggtgtgagcccgcaccgg

SEQ ID NO: 8914 - DNA, 19 bp, Artificial Sequence
  Description of Artificial Sequence: Chemically synthesized oligonucleotide
ccggtgcgggctcacacca

SEQ ID NO: 8915 - DNA, 19 bp, Artificial Sequence
  Description of Artificial Sequence: Chemically synthesized oligonucleotide
ggtgtgagcccgcaccggg

SEQ ID NO: 8916 - DNA, 19 bp, Artificial Sequence
  Description of Artificial Sequence: Chemically synthesized oligonucleotide
cccggtgcgggctcacacc

SEQ ID NO: 8917 - DNA, 19 bp, Artificial Sequence
  Description of Artificial Sequence: Chemically synthesized oligonucleotide
gtgtgagcccgcaccgggg

SEQ ID NO: 8918 - DNA, 19 bp, Artificial Sequence
  Description of Artificial Sequence: Chemically synthesized oligonucleotide
ccccggtgcgggctcacac

SEQ ID NO: 8919 - DNA, 19 bp, Artificial Sequence
  Description of Artificial Sequence: Chemically synthesized oligonucleotide
tgtgagcccgcaccgggga

SEQ ID NO: 8920 - DNA, 19 bp, Artificial Sequence
  Description of Artificial Sequence: Chemically synthesized oligonucleotide
tccccggtgcgggctcaca

SEQ ID NO: 8921 - DNA, 19 bp, Artificial Sequence
  Description of Artificial Sequence: Chemically synthesized oligonucleotide
gtgagcccgcaccggggac

SEQ ID NO: 8922 - DNA, 19 bp, Artificial Sequence
  Description of Artificial Sequence: Chemically synthesized oligonucleotide
gtccccggtgcgggctcac

SEQ ID NO: 8923 - DNA, 19 bp, Artificial Sequence
  Description of Artificial Sequence: Chemically synthesized oligonucleotide
tgagcccgcaccggggaca

SEQ ID NO: 8924 - DNA, 19 bp, Artificial Sequence
  Description of Artificial Sequence: Chemically synthesized oligonucleotide
tgtccccggtgcgggctca

SEQ ID NO: 8925 - DNA, 19 bp, Artificial Sequence
  Description of Artificial Sequence: Chemically synthesized oligonucleotide
gagcccgcaccggggacac

SEQ ID NO: 8926 - DNA, 19 bp, Artificial Sequence
  Description of Artificial Sequence: Chemically synthesized oligonucleotide
gtgtccccggtgcgggctc

SEQ ID NO: 8927 - DNA, 19 bp, Artificial Sequence
  Description of Artificial Sequence: Chemically synthesized oligonucleotide
agcccgcaccggggacacc

SEQ ID NO: 8928 - DNA, 19 bp, Artificial Sequence
  Description of Artificial Sequence: Chemically synthesized oligonucleotide
ggtgtccccggtgcgggct

SEQ ID NO: 8929 - DNA, 19 bp, Artificial Sequence
  Description of Artificial Sequence: Chemically synthesized oligonucleotide
gcccgcaccggggacacct

SEQ ID NO: 8930 - DNA, 19 bp, Artificial Sequence
  Description of Artificial Sequence: Chemically synthesized oligonucleotide
aggtgtccccggtgcgggc

SEQ ID NO: 8931 - DNA, 19 bp, Artificial Sequence
  Description of Artificial Sequence: Chemically synthesized oligonucleotide
cccgcaccggggacacctg

SEQ ID NO: 8932 - DNA, 19 bp, Artificial Sequence
  Description of Artificial Sequence: Chemically synthesized oligonucleotide
caggtgtccccggtgcggg

SEQ ID NO: 8933 - DNA, 19 bp, Artificial Sequence
  Description of Artificial Sequence: Chemically synthesized oligonucleotide
ccgcaccggggacacctgg

SEQ ID NO: 8934 - DNA, 19 bp, Artificial Sequence
  Description of Artificial Sequence: Chemically synthesized oligonucleotide
ccaggtgtccccggtgcgg

SEQ ID NO: 8935 - DNA, 19 bp, Artificial Sequence
  Description of Artificial Sequence: Chemically synthesized oligonucleotide
cgcaccggggacacctggg

SEQ ID NO: 8936 - DNA, 19 bp, Artificial Sequence
  Description of Artificial Sequence: Chemically synthesized oligonucleotide
cccaggtgtccccggtgcg

SEQ ID NO: 8937 - DNA, 19 bp, Artificial Sequence
  Description of Artificial Sequence: Chemically synthesized oligonucleotide
gcaccggggacacctgggg

SEQ ID NO: 8938 - DNA, 19 bp, Artificial Sequence
  Description of Artificial Sequence: Chemically synthesized oligonucleotide
ccccaggtgtccccggtgc

SEQ ID NO: 8939 - DNA, 19 bp, Artificial Sequence
  Description of Artificial Sequence: Chemically synthesized oligonucleotide
caccggggacacctgggga

SEQ ID NO: 8940 - DNA, 19 bp, Artificial Sequence
  Description of Artificial Sequence: Chemically synthesized oligonucleotide
tccccaggtgtccccggtg

SEQ ID NO: 8941 - DNA, 19 bp, Artificial Sequence
  Description of Artificial Sequence: Chemically synthesized oligonucleotide
accggggacacctggggac

SEQ ID NO: 8942 - DNA, 19 bp, Artificial Sequence
  Description of Artificial Sequence: Chemically synthesized oligonucleotide
gtccccaggtgtccccggt

SEQ ID NO: 8943 - DNA, 19 bp, Artificial Sequence
  Description of Artificial Sequence: Chemically synthesized oligonucleotide
ccggggacacctggggacc

SEQ ID NO: 8944 - DNA, 19 bp, Artificial Sequence
  Description of Artificial Sequence: Chemically synthesized oligonucleotide
ggtccccaggtgtccccgg

SEQ ID NO: 8945 - DNA, 19 bp, Artificial Sequence
  Description of Artificial Sequence: Chemically synthesized oligonucleotide
cggggacacctggggacca

SEQ ID NO: 8946 - DNA, 19 bp, Artificial Sequence
  Description of Artificial Sequence: Chemically synthesized oligonucleotide
tggtccccaggtgtccccg

SEQ ID NO: 8947 - DNA, 19 bp, Artificial Sequence
  Description of Artificial Sequence: Chemically synthesized oligonucleotide
ggggacacctggggaccaa

SEQ ID NO: 8948 - DNA, 19 bp, Artificial Sequence
  Description of Artificial Sequence: Chemically synthesized oligonucleotide
ttggtccccaggtgtcccc

SEQ ID NO: 8949 - DNA, 19 bp, Artificial Sequence
  Description of Artificial Sequence: Chemically synthesized oligonucleotide
gggacacctggggaccaag

SEQ ID NO: 8950 - DNA, 19 bp, Artificial Sequence
  Description of Artificial Sequence: Chemically synthesized oligonucleotide
cttggtccccaggtgtccc

SEQ ID NO: 8951 - DNA, 19 bp, Artificial Sequence
  Description of Artificial Sequence: Chemically synthesized oligonucleotide
ggacacctggggaccaaga

SEQ ID NO: 8952 - DNA, 19 bp, Artificial Sequence
  Description of Artificial Sequence: Chemically synthesized oligonucleotide
tcttggtccccaggtgtcc

SEQ ID NO: 8953 - DNA, 19 bp, Artificial Sequence
  Description of Artificial Sequence: Chemically synthesized oligonucleotide
gacacctggggaccaagaa

SEQ ID NO: 8954 - DNA, 19 bp, Artificial Sequence
  Description of Artificial Sequence: Chemically synthesized oligonucleotide
ttcttggtccccaggtgtc

SEQ ID NO: 8955 - DNA, 19 bp, Artificial Sequence
  Description of Artificial Sequence: Chemically synthesized oligonucleotide
acacctggggaccaagaac

SEQ ID NO: 8956 - DNA, 19 bp, Artificial Sequence
  Description of Artificial Sequence: Chemically synthesized oligonucleotide
gttcttggtccccaggtgt

SEQ ID NO: 8957 - DNA, 19 bp, Artificial Sequence
  Description of Artificial Sequence: Chemically synthesized oligonucleotide
cacctggggaccaagaacc

SEQ ID NO: 8958 - DNA, 19 bp, Artificial Sequence
  Description of Artificial Sequence: Chemically synthesized oligonucleotide
ggttcttggtccccaggtg

SEQ ID NO: 8959 - DNA, 19 bp, Artificial Sequence
  Description of Artificial Sequence: Chemically synthesized oligonucleotide
acctggggaccaagaacct

SEQ ID NO: 8960 - DNA, 19 bp, Artificial Sequence
  Description of Artificial Sequence: Chemically synthesized oligonucleotide
aggttcttggtccccaggt

SEQ ID NO: 8961 - DNA, 19 bp, Artificial Sequence
  Description of Artificial Sequence: Chemically synthesized oligonucleotide
cctggggaccaagaacctc

SEQ ID NO: 8962 - DNA, 19 bp, Artificial Sequence
  Description of Artificial Sequence: Chemically synthesized oligonucleotide
gaggttcttggtccccagg

SEQ ID NO: 8963 - DNA, 19 bp, Artificial Sequence
  Description of Artificial Sequence: Chemically synthesized oligonucleotide
ctggggaccaagaacctct

SEQ ID NO: 8964 - DNA, 19 bp, Artificial Sequence
  Description of Artificial Sequence: Chemically synthesized oligonucleotide
agaggttcttggtccccag

SEQ ID NO: 8965 - DNA, 19 bp, Artificial Sequence
  Description of Artificial Sequence: Chemically synthesized oligonucleotide
tggggaccaagaacctctg

SEQ ID NO: 8966 - DNA, 19 bp, Artificial Sequence
  Description of Artificial Sequence: Chemically synthesized oligonucleotide
cagaggttcttggtcccca

SEQ ID NO: 8967 - DNA, 19 bp, Artificial Sequence
  Description of Artificial Sequence: Chemically synthesized oligonucleotide
ggggaccaagaacctctgt

SEQ ID NO: 8968 - DNA, 19 bp, Artificial Sequence
  Description of Artificial Sequence: Chemically synthesized oligonucleotide
acagaggttcttggtcccc

SEQ ID NO: 8969 - DNA, 19 bp, Artificial Sequence
  Description of Artificial Sequence: Chemically synthesized oligonucleotide
gggaccaagaacctctgtg

SEQ ID NO: 8970 - DNA, 19 bp, Artificial Sequence
  Description of Artificial Sequence: Chemically synthesized oligonucleotide
cacagaggttcttggtccc

SEQ ID NO: 8971 - DNA, 19 bp, Artificial Sequence
  Description of Artificial Sequence: Chemically synthesized oligonucleotide
ggaccaagaacctctgtgt

SEQ ID NO: 8972 - DNA, 19 bp, Artificial Sequence
  Description of Artificial Sequence: Chemically synthesized oligonucleotide
acacagaggttcttggtcc

SEQ ID NO: 8973 - DNA, 19 bp, Artificial Sequence
  Description of Artificial Sequence: Chemically synthesized oligonucleotide
gaccaagaacctctgtgtg

SEQ ID NO: 8974 - DNA, 19 bp, Artificial Sequence
  Description of Artificial Sequence: Chemically synthesized oligonucleotide
cacacagaggttcttggtc

SEQ ID NO: 8975 - DNA, 19 bp, Artificial Sequence
  Description of Artificial Sequence: Chemically synthesized oligonucleotide
accaagaacctctgtgtgg

SEQ ID NO: 8976 - DNA, 19 bp, Artificial Sequence
  Description of Artificial Sequence: Chemically synthesized oligonucleotide
ccacacagaggttcttggt

SEQ ID NO: 8977 - DNA, 19 bp, Artificial Sequence
  Description of Artificial Sequence: Chemically synthesized oligonucleotide
ccaagaacctctgtgtgga

SEQ ID NO: 8978 - DNA, 19 bp, Artificial Sequence
  Description of Artificial Sequence: Chemically synthesized oligonucleotide
tccacacagaggttcttgg

SEQ ID NO: 8979 - DNA, 19 bp, Artificial Sequence
  Description of Artificial Sequence: Chemically synthesized oligonucleotide
caagaacctctgtgtggag

SEQ ID NO: 8980 - DNA, 19 bp, Artificial Sequence
  Description of Artificial Sequence: Chemically synthesized oligonucleotide
ctccacacagaggttcttg

SEQ ID NO: 8981 - DNA, 19 bp, Artificial Sequence
  Description of Artificial Sequence: Chemically synthesized oligonucleotide
aagaacctctgtgtggagg

SEQ ID NO: 8982 - DNA, 19 bp, Artificial Sequence
  Description of Artificial Sequence: Chemically synthesized oligonucleotide
cctccacacagaggttctt

SEQ ID NO: 8983 - DNA, 19 bp, Artificial Sequence
  Description of Artificial Sequence: Chemically synthesized oligonucleotide
agaacctctgtgtggaggt

SEQ ID NO: 8984 - DNA, 19 bp, Artificial Sequence
  Description of Artificial Sequence: Chemically synthesized oligonucleotide
acctccacacagaggttct

SEQ ID NO: 8985 - DNA, 19 bp, Artificial Sequence
  Description of Artificial Sequence: Chemically synthesized oligonucleotide
gaacctctgtgtggaggtg

SEQ ID NO: 8986 - DNA, 19 bp, Artificial Sequence
  Description of Artificial Sequence: Chemically synthesized oligonucleotide
cacctccacacagaggttc

SEQ ID NO: 8987 - DNA, 19 bp, Artificial Sequence
  Description of Artificial Sequence: Chemically synthesized oligonucleotide
aacctctgtgtggaggtgg

SEQ ID NO: 8988 - DNA, 19 bp, Artificial Sequence
  Description of Artificial Sequence: Chemically synthesized oligonucleotide
ccacctccacacagaggtt

SEQ ID NO: 8989 - DNA, 19 bp, Artificial Sequence
  Description of Artificial Sequence: Chemically synthesized oligonucleotide
acctctgtgtggaggtggc

SEQ ID NO: 8990 - DNA, 19 bp, Artificial Sequence
  Description of Artificial Sequence: Chemically synthesized oligonucleotide
gccacctccacacagaggt

SEQ ID NO: 8991 - DNA, 19 bp, Artificial Sequence
  Description of Artificial Sequence: Chemically synthesized oligonucleotide
cctctgtgtggaggtggcc

SEQ ID NO: 8992 - DNA, 19 bp, Artificial Sequence
  Description of Artificial Sequence: Chemically synthesized oligonucleotide
ggccacctccacacagagg

SEQ ID NO: 8993 - DNA, 19 bp, Artificial Sequence
  Description of Artificial Sequence: Chemically synthesized oligonucleotide
ctctgtgtggaggtggccg

SEQ ID NO: 8994 - DNA, 19 bp, Artificial Sequence
  Description of Artificial Sequence: Chemically synthesized oligonucleotide
cggccacctccacacagag

SEQ ID NO: 8995 - DNA, 19 bp, Artificial Sequence
  Description of Artificial Sequence: Chemically synthesized oligonucleotide
tctgtgtggaggtggccga

SEQ ID NO: 8996 - DNA, 19 bp, Artificial Sequence
  Description of Artificial Sequence: Chemically synthesized oligonucleotide
tcggccacctccacacaga

SEQ ID NO: 8997 - DNA, 19 bp, Artificial Sequence
  Description of Artificial Sequence: Chemically synthesized oligonucleotide
ctgtgtggaggtggccgac

SEQ ID NO: 8998 - DNA, 19 bp, Artificial Sequence
  Description of Artificial Sequence: Chemically synthesized oligonucleotide
gtcggccacctccacacag

SEQ ID NO: 8999 - DNA, 19 bp, Artificial Sequence
  Description of Artificial Sequence: Chemically synthesized oligonucleotide
tgtgtggaggtggccgacc

SEQ ID NO: 9000 - DNA, 19 bp, Artificial Sequence
  Description of Artificial Sequence: Chemically synthesized oligonucleotide
ggtcggccacctccacaca

SEQ ID NO: 9001 - DNA, 19 bp, Artificial Sequence
  Description of Artificial Sequence: Chemically synthesized oligonucleotide
gtgtggaggtggccgacct

SEQ ID NO: 9002 - DNA, 19 bp, Artificial Sequence
  Description of Artificial Sequence: Chemically synthesized oligonucleotide
aggtcggccacctccacac

SEQ ID NO: 9003 - DNA, 19 bp, Artificial Sequence
  Description of Artificial Sequence: Chemically synthesized oligonucleotide
tgtggaggtggccgacctg

SEQ ID NO: 9004 - DNA, 19 bp, Artificial Sequence
  Description of Artificial Sequence: Chemically synthesized oligonucleotide
caggtcggccacctccaca

SEQ ID NO: 9005 - DNA, 19 bp, Artificial Sequence
  Description of Artificial Sequence: Chemically synthesized oligonucleotide
gtggaggtggccgacctgg

SEQ ID NO: 9006 - DNA, 19 bp, Artificial Sequence
  Description of Artificial Sequence: Chemically synthesized oligonucleotide
ccaggtcggccacctccac

SEQ ID NO: 9007 - DNA, 19 bp, Artificial Sequence
  Description of Artificial Sequence: Chemically synthesized oligonucleotide
tggaggtggccgacctggt

SEQ ID NO: 9008 - DNA, 19 bp, Artificial Sequence
  Description of Artificial Sequence: Chemically synthesized oligonucleotide
accaggtcggccacctcca

SEQ ID NO: 9009 - DNA, 19 bp, Artificial Sequence
  Description of Artificial Sequence: Chemically synthesized oligonucleotide
ggaggtggccgacctggtc

SEQ ID NO: 9010 - DNA, 19 bp, Artificial Sequence
  Description of Artificial Sequence: Chemically synthesized oligonucleotide
gaccaggtcggccacctcc

SEQ ID NO: 9011 - DNA, 19 bp, Artificial Sequence
  Description of Artificial Sequence: Chemically synthesized oligonucleotide
gaggtggccgacctggtca

SEQ ID NO: 9012 - DNA, 19 bp, Artificial Sequence
  Description of Artificial Sequence: Chemically synthesized oligonucleotide
tgaccaggtcggccacctc

SEQ ID NO: 9013 - DNA, 19 bp, Artificial Sequence
  Description of Artificial Sequence: Chemically synthesized oligonucleotide
aggtggccgacctggtcag

SEQ ID NO: 9014 - DNA, 19 bp, Artificial Sequence
  Description of Artificial Sequence: Chemically synthesized oligonucleotide
ctgaccaggtcggccacct

SEQ ID NO: 9015 - DNA, 19 bp, Artificial Sequence
  Description of Artificial Sequence: Chemically synthesized oligonucleotide
ggtggccgacctggtcagc

SEQ ID NO: 9016 - DNA, 19 bp, Artificial Sequence
  Description of Artificial Sequence: Chemically synthesized oligonucleotide
gctgaccaggtcggccacc

SEQ ID NO: 9017 - DNA, 19 bp, Artificial Sequence
  Description of Artificial Sequence: Chemically synthesized oligonucleotide
gtggccgacctggtcagca

SEQ ID NO: 9018 - DNA, 19 bp, Artificial Sequence
  Description of Artificial Sequence: Chemically synthesized oligonucleotide
tgctgaccaggtcggccac

SEQ ID NO: 9019 - DNA, 19 bp, Artificial Sequence
  Description of Artificial Sequence: Chemically synthesized oligonucleotide
tggccgacctggtcagcat

SEQ ID NO: 9020 - DNA, 19 bp, Artificial Sequence
  Description of Artificial Sequence: Chemically synthesized oligonucleotide
atgctgaccaggtcggcca

SEQ ID NO: 9021 - DNA, 19 bp, Artificial Sequence
  Description of Artificial Sequence: Chemically synthesized oligonucleotide
ggccgacctggtcagcatc

SEQ ID NO: 9022 - DNA, 19 bp, Artificial Sequence
  Description of Artificial Sequence: Chemically synthesized oligonucleotide
gatgctgaccaggtcggcc

SEQ ID NO: 9023 - DNA, 19 bp, Artificial Sequence
  Description of Artificial Sequence: Chemically synthesized oligonucleotide
gccgacctggtcagcatcc

SEQ ID NO: 9024 - DNA, 19 bp, Artificial Sequence
  Description of Artificial Sequence: Chemically synthesized oligonucleotide
ggatgctgaccaggtcggc

SEQ ID NO: 9025 - DNA, 19 bp, Artificial Sequence
  Description of Artificial Sequence: Chemically synthesized oligonucleotide
ccgacctggtcagcatcct

SEQ ID NO: 9026 - DNA, 19 bp, Artificial Sequence
  Description of Artificial Sequence: Chemically synthesized oligonucleotide
aggatgctgaccaggtcgg

SEQ ID NO: 9027 - DNA, 19 bp, Artificial Sequence
  Description of Artificial Sequence: Chemically synthesized oligonucleotide
cgacctggtcagcatcctg

SEQ ID NO: 9028 - DNA, 19 bp, Artificial Sequence
  Description of Artificial Sequence: Chemically synthesized oligonucleotide
caggatgctgaccaggtcg

SEQ ID NO: 9029 - DNA, 19 bp, Artificial Sequence
  Description of Artificial Sequence: Chemically synthesized oligonucleotide
gacctggtcagcatcctgg

SEQ ID NO: 9030 - DNA, 19 bp, Artificial Sequence
  Description of Artificial Sequence: Chemically synthesized oligonucleotide
ccaggatgctgaccaggtc

SEQ ID NO: 9031 - DNA, 19 bp, Artificial Sequence
  Description of Artificial Sequence: Chemically synthesized oligonucleotide
acctggtcagcatcctggt

SEQ ID NO: 9032 - DNA, 19 bp, Artificial Sequence
  Description of Artificial Sequence: Chemically synthesized oligonucleotide
accaggatgctgaccaggt

SEQ ID NO: 9033 - DNA, 19 bp, Artificial Sequence
  Description of Artificial Sequence: Chemically synthesized oligonucleotide
cctggtcagcatcctggtg

SEQ ID NO: 9034 - DNA, 19 bp, Artificial Sequence
  Description of Artificial Sequence: Chemically synthesized oligonucleotide
caccaggatgctgaccagg

SEQ ID NO: 9035 - DNA, 19 bp, Artificial Sequence
  Description of Artificial Sequence: Chemically synthesized oligonucleotide
ctggtcagcatcctggtgc

SEQ ID NO: 9036 - DNA, 19 bp, Artificial Sequence
  Description of Artificial Sequence: Chemically synthesized oligonucleotide
gcaccaggatgctgaccag

SEQ ID NO: 9037 - DNA, 19 bp, Artificial Sequence
  Description of Artificial Sequence: Chemically synthesized oligonucleotide
tggtcagcatcctggtgca

SEQ ID NO: 9038 - DNA, 19 bp, Artificial Sequence
  Description of Artificial Sequence: Chemically synthesized oligonucleotide
tgcaccaggatgctgacca

SEQ ID NO: 9039 - DNA, 19 bp, Artificial Sequence
  Description of Artificial Sequence: Chemically synthesized oligonucleotide
ggtcagcatcctggtgcat

SEQ ID NO: 9040 - DNA, 19 bp, Artificial Sequence
  Description of Artificial Sequence: Chemically synthesized oligonucleotide
atgcaccaggatgctgacc

SEQ ID NO: 9041 - DNA, 19 bp, Artificial Sequence
  Description of Artificial Sequence: Chemically synthesized oligonucleotide
gtcagcatcctggtgcatg

SEQ ID NO: 9042 - DNA, 19 bp, Artificial Sequence
  Description of Artificial Sequence: Chemically synthesized oligonucleotide
catgcaccaggatgctgac

SEQ ID NO: 9043 - DNA, 19 bp, Artificial Sequence
  Description of Artificial Sequence: Chemically synthesized oligonucleotide
tcagcatcctggtgcatgc

SEQ ID NO: 9044 - DNA, 19 bp, Artificial Sequence
  Description of Artificial Sequence: Chemically synthesized oligonucleotide
gcatgcaccaggatgctga

SEQ ID NO: 9045 - DNA, 19 bp, Artificial Sequence
  Description of Artificial Sequence: Chemically synthesized oligonucleotide
cagcatcctggtgcatgcc

SEQ ID NO: 9046 - DNA, 19 bp, Artificial Sequence
  Description of Artificial Sequence: Chemically synthesized oligonucleotide
ggcatgcaccaggatgctg

SEQ ID NO: 9047 - DNA, 19 bp, Artificial Sequence
  Description of Artificial Sequence: Chemically synthesized oligonucleotide
agcatcctggtgcatgccg

SEQ ID NO: 9048 - DNA, 19 bp, Artificial Sequence
  Description of Artificial Sequence: Chemically synthesized oligonucleotide
cggcatgcaccaggatgct

SEQ ID NO: 9049 - DNA, 19 bp, Artificial Sequence
  Description of Artificial Sequence: Chemically synthesized oligonucleotide
gcatcctggtgcatgccga

SEQ ID NO: 9050 - DNA, 19 bp, Artificial Sequence
  Description of Artificial Sequence: Chemically synthesized oligonucleotide
tcggcatgcaccaggatgc

SEQ ID NO: 9051 - DNA, 19 bp, Artificial Sequence
  Description of Artificial Sequence: Chemically synthesized oligonucleotide
catcctggtgcatgccgac

SEQ ID NO: 9052 - DNA, 19 bp, Artificial Sequence
  Description of Artificial Sequence: Chemically synthesized oligonucleotide
gtcggcatgcaccaggatg

SEQ ID NO: 9053 - DNA, 19 bp, Artificial Sequence
  Description of Artificial Sequence: Chemically synthesized oligonucleotide
atcctggtgcatgccgaca

SEQ ID NO: 9054 - DNA, 19 bp, Artificial Sequence
  Description of Artificial Sequence: Chemically synthesized oligonucleotide
tgtcggcatgcaccaggat

SEQ ID NO: 9055 - DNA, 19 bp, Artificial Sequence
  Description of Artificial Sequence: Chemically synthesized oligonucleotide
tcctggtgcatgccgacac

SEQ ID NO: 9056 - DNA, 19 bp, Artificial Sequence
  Description of Artificial Sequence: Chemically synthesized oligonucleotide
gtgtcggcatgcaccagga

SEQ ID NO: 9057 - DNA, 19 bp, Artificial Sequence
  Description of Artificial Sequence: Chemically synthesized oligonucleotide
cctggtgcatgccgacaca

SEQ ID NO: 9058 - DNA, 19 bp, Artificial Sequence
  Description of Artificial Sequence: Chemically synthesized oligonucleotide
tgtgtcggcatgcaccagg

SEQ ID NO: 9059 - DNA, 19 bp, Artificial Sequence
  Description of Artificial Sequence: Chemically synthesized oligonucleotide
ctggtgcatgccgacacac

SEQ ID NO: 9060 - DNA, 19 bp, Artificial Sequence
  Description of Artificial Sequence: Chemically synthesized oligonucleotide
gtgtgtcggcatgcaccag

SEQ ID NO: 9061 - DNA, 19 bp, Artificial Sequence
  Description of Artificial Sequence: Chemically synthesized oligonucleotide
tggtgcatgccgacacacc

SEQ ID NO: 9062 - DNA, 19 bp, Artificial Sequence
  Description of Artificial Sequence: Chemically synthesized oligonucleotide
ggtgtgtcggcatgcacca

SEQ ID NO: 9063 - DNA, 19 bp, Artificial Sequence
  Description of Artificial Sequence: Chemically synthesized oligonucleotide
ggtgcatgccgacacacca

SEQ ID NO: 9064 - DNA, 19 bp, Artificial Sequence
  Description of Artificial Sequence: Chemically synthesized oligonucleotide
tggtgtgtcggcatgcacc

SEQ ID NO: 9065 - DNA, 19 bp, Artificial Sequence
  Description of Artificial Sequence: Chemically synthesized oligonucleotide
gtgcatgccgacacaccac

SEQ ID NO: 9066 - DNA, 19 bp, Artificial Sequence
  Description of Artificial Sequence: Chemically synthesized oligonucleotide
gtggtgtgtcggcatgcac

SEQ ID NO: 9067 - DNA, 19 bp, Artificial Sequence
  Description of Artificial Sequence: Chemically synthesized oligonucleotide
tgcatgccgacacaccact

SEQ ID NO: 9068 - DNA, 19 bp, Artificial Sequence
  Description of Artificial Sequence: Chemically synthesized oligonucleotide
agtggtgtgtcggcatgca

SEQ ID NO: 9069 - DNA, 19 bp, Artificial Sequence
  Description of Artificial Sequence: Chemically synthesized oligonucleotide
gcatgccgacacaccactg

SEQ ID NO: 9070 - DNA, 19 bp, Artificial Sequence
  Description of Artificial Sequence: Chemically synthesized oligonucleotide
cagtggtgtgtcggcatgc

SEQ ID NO: 9071 - DNA, 19 bp, Artificial Sequence
  Description of Artificial Sequence: Chemically synthesized oligonucleotide
catgccgacacaccactgc

SEQ ID NO: 9072 - DNA, 19 bp, Artificial Sequence
  Description of Artificial Sequence: Chemically synthesized oligonucleotide
gcagtggtgtgtcggcatg

SEQ ID NO: 9073 - DNA, 19 bp, Artificial Sequence
  Description of Artificial Sequence: Chemically synthesized oligonucleotide
atgccgacacaccactgcc

SEQ ID NO: 9074 - DNA, 19 bp, Artificial Sequence
  Description of Artificial Sequence: Chemically synthesized oligonucleotide
ggcagtggtgtgtcggcat

SEQ ID NO: 9075 - DNA, 19 bp, Artificial Sequence
  Description of Artificial Sequence: Chemically synthesized oligonucleotide
tgccgacacaccactgcct

SEQ ID NO: 9076 - DNA, 19 bp, Artificial Sequence
  Description of Artificial Sequence: Chemically synthesized oligonucleotide
aggcagtggtgtgtcggca

SEQ ID NO: 9077 - DNA, 19 bp, Artificial Sequence
  Description of Artificial Sequence: Chemically synthesized oligonucleotide
gccgacacaccactgcctg

SEQ ID NO: 9078 - DNA, 19 bp, Artificial Sequence
  Description of Artificial Sequence: Chemically synthesized oligonucleotide
caggcagtggtgtgtcggc

SEQ ID NO: 9079 - DNA, 19 bp, Artificial Sequence
  Description of Artificial Sequence: Chemically synthesized oligonucleotide
ccgacacaccactgcctgc

SEQ ID NO: 9080 - DNA, 19 bp, Artificial Sequence
  Description of Artificial Sequence: Chemically synthesized oligonucleotide
gcaggcagtggtgtgtcgg

SEQ ID NO: 9081 - DNA, 19 bp, Artificial Sequence
  Description of Artificial Sequence: Chemically synthesized oligonucleotide
cgacacaccactgcctgcc

SEQ ID NO: 9082 - DNA, 19 bp, Artificial Sequence
  Description of Artificial Sequence: Chemically synthesized oligonucleotide
ggcaggcagtggtgtgtcg

SEQ ID NO: 9083 - DNA, 19 bp, Artificial Sequence
  Description of Artificial Sequence: Chemically synthesized oligonucleotide
gacacaccactgcctgcct

SEQ ID NO: 9084 - DNA, 19 bp, Artificial Sequence
  Description of Artificial Sequence: Chemically synthesized oligonucleotide
aggcaggcagtggtgtgtc

SEQ ID NO: 9085 - DNA, 19 bp, Artificial Sequence
  Description of Artificial Sequence: Chemically synthesized oligonucleotide
acacaccactgcctgcctg

SEQ ID NO: 9086 - DNA, 19 bp, Artificial Sequence
  Description of Artificial Sequence: Chemically synthesized oligonucleotide
caggcaggcagtggtgtgt

SEQ ID NO: 9087 - DNA, 19 bp, Artificial Sequence
  Description of Artificial Sequence: Chemically synthesized oligonucleotide
cacaccactgcctgcctgg

SEQ ID NO: 9088 - DNA, 19 bp, Artificial Sequence
  Description of Artificial Sequence: Chemically synthesized oligonucleotide
ccaggcaggcagtggtgtg

SEQ ID NO: 9089 - DNA, 19 bp, Artificial Sequence
  Description of Artificial Sequence: Chemically synthesized oligonucleotide
acaccactgcctgcctggc

SEQ ID NO: 9090 - DNA, 19 bp, Artificial Sequence
  Description of Artificial Sequence: Chemically synthesized oligonucleotide
gccaggcaggcagtggtgt

SEQ ID NO: 9091 - DNA, 19 bp, Artificial Sequence
  Description of Artificial Sequence: Chemically synthesized oligonucleotide
caccactgcctgcctggca

SEQ ID NO: 9092 - DNA, 19 bp, Artificial Sequence
  Description of Artificial Sequence: Chemically synthesized oligonucleotide
tgccaggcaggcagtggtg

SEQ ID NO: 9093 - DNA, 19 bp, Artificial Sequence
  Description of Artificial Sequence: Chemically synthesized oligonucleotide
accactgcctgcctggcac

SEQ ID NO: 9094 - DNA, 19 bp, Artificial Sequence
  Description of Artificial Sequence: Chemically synthesized oligonucleotide
gtgccaggcaggcagtggt

SEQ ID NO: 9095 - DNA, 19 bp, Artificial Sequence
  Description of Artificial Sequence: Chemically synthesized oligonucleotide
ccactgcctgcctggcacc

SEQ ID NO: 9096 - DNA, 19 bp, Artificial Sequence
  Description of Artificial Sequence: Chemically synthesized oligonucleotide
ggtgccaggcaggcagtgg

SEQ ID NO: 9097 - DNA, 19 bp, Artificial Sequence
  Description of Artificial Sequence: Chemically synthesized oligonucleotide
cactgcctgcctggcaccg

SEQ ID NO: 9098 - DNA, 19 bp, Artificial Sequence
  Description of Artificial Sequence: Chemically synthesized oligonucleotide
cggtgccaggcaggcagtg

SEQ ID NO: 9099 - DNA, 19 bp, Artificial Sequence
  Description of Artificial Sequence: Chemically synthesized oligonucleotide
actgcctgcctggcaccgg

SEQ ID NO: 9100 - DNA, 19 bp, Artificial Sequence
  Description of Artificial Sequence: Chemically synthesized oligonucleotide
ccggtgccaggcaggcagt

SEQ ID NO: 9101 - DNA, 19 bp, Artificial Sequence
  Description of Artificial Sequence: Chemically synthesized oligonucleotide
ctgcctgcctggcaccggg

SEQ ID NO: 9102 - DNA, 19 bp, Artificial Sequence
  Description of Artificial Sequence: Chemically synthesized oligonucleotide
cccggtgccaggcaggcag

SEQ ID NO: 9103 - DNA, 19 bp, Artificial Sequence
  Description of Artificial Sequence: Chemically synthesized oligonucleotide
tgcctgcctggcaccgggc

SEQ ID NO: 9104 - DNA, 19 bp, Artificial Sequence
  Description of Artificial Sequence: Chemically synthesized oligonucleotide
gcccggtgccaggcaggca

SEQ ID NO: 9105 - DNA, 19 bp, Artificial Sequence
  Description of Artificial Sequence: Chemically synthesized oligonucleotide
gcctgcctggcaccgggca

SEQ ID NO: 9106 - DNA, 19 bp, Artificial Sequence
  Description of Artificial Sequence: Chemically synthesized oligonucleotide
tgcccggtgccaggcaggc

SEQ ID NO: 9107 - DNA, 19 bp, Artificial Sequence
  Description of Artificial Sequence: Chemically synthesized oligonucleotide
cctgcctggcaccgggcac

SEQ ID NO: 9108 - DNA, 19 bp, Artificial Sequence
  Description of Artificial Sequence: Chemically synthesized oligonucleotide
gtgcccggtgccaggcagg

SEQ ID NO: 9109 - DNA, 19 bp, Artificial Sequence
  Description of Artificial Sequence: Chemically synthesized oligonucleotide
ctgcctggcaccgggcaca

SEQ ID NO: 9110 - DNA, 19 bp, Artificial Sequence
  Description of Artificial Sequence: Chemically synthesized oligonucleotide
tgtgcccggtgccaggcag

SEQ ID NO: 9111 - DNA, 19 bp, Artificial Sequence
  Description of Artificial Sequence: Chemically synthesized oligonucleotide
tgcctggcaccgggcacag

SEQ ID NO: 9112 - DNA, 19 bp, Artificial Sequence
  Description of Artificial Sequence: Chemically synthesized oligonucleotide
ctgtgcccggtgccaggca

SEQ ID NO: 9113 - DNA, 19 bp, Artificial Sequence
  Description of Artificial Sequence: Chemically synthesized oligonucleotide
gcctggcaccgggcacaga

SEQ ID NO: 9114 - DNA, 19 bp, Artificial Sequence
  Description of Artificial Sequence: Chemically synthesized oligonucleotide
tctgtgcccggtgccaggc

SEQ ID NO: 9115 - DNA, 19 bp, Artificial Sequence
  Description of Artificial Sequence: Chemically synthesized oligonucleotide
cctggcaccgggcacagaa

SEQ ID NO: 9116 - DNA, 19 bp, Artificial Sequence
  Description of Artificial Sequence: Chemically synthesized oligonucleotide
ttctgtgcccggtgccagg

SEQ ID NO: 9117 - DNA, 19 bp, Artificial Sequence
  Description of Artificial Sequence: Chemically synthesized oligonucleotide
ctggcaccgggcacagaaa

SEQ ID NO: 9118 - DNA, 19 bp, Artificial Sequence
  Description of Artificial Sequence: Chemically synthesized oligonucleotide
tttctgtgcccggtgccag

SEQ ID NO: 9119 - DNA, 19 bp, Artificial Sequence
  Description of Artificial Sequence: Chemically synthesized oligonucleotide
tggcaccgggcacagaaag

SEQ ID NO: 9120 - DNA, 19 bp, Artificial Sequence
  Description of Artificial Sequence: Chemically synthesized oligonucleotide
ctttctgtgcccggtgcca

SEQ ID NO: 9121 - DNA, 19 bp, Artificial Sequence
  Description of Artificial Sequence: Chemically synthesized oligonucleotide
ggcaccgggcacagaaaga

SEQ ID NO: 9122 - DNA, 19 bp, Artificial Sequence
  Description of Artificial Sequence: Chemically synthesized oligonucleotide
tctttctgtgcccggtgcc

SEQ ID NO: 9123 - DNA, 19 bp, Artificial Sequence
  Description of Artificial Sequence: Chemically synthesized oligonucleotide
gcaccgggcacagaaagac

SEQ ID NO: 9124 - DNA, 19 bp, Artificial Sequence
  Description of Artificial Sequence: Chemically synthesized oligonucleotide
gtctttctgtgcccggtgc

SEQ ID NO: 9125 - DNA, 19 bp, Artificial Sequence
  Description of Artificial Sequence: Chemically synthesized oligonucleotide
caccgggcacagaaagact

SEQ ID NO: 9126 - DNA, 19 bp, Artificial Sequence
  Description of Artificial Sequence: Chemically synthesized oligonucleotide
agtctttctgtgcccggtg

SEQ ID NO: 9127 - DNA, 19 bp, Artificial Sequence
  Description of Artificial Sequence: Chemically synthesized oligonucleotide
accgggcacagaaagactt

SEQ ID NO: 9128 - DNA, 19 bp, Artificial Sequence
  Description of Artificial Sequence: Chemically synthesized oligonucleotide
aagtctttctgtgcccggt

SEQ ID NO: 9129 - DNA, 19 bp, Artificial Sequence
  Description of Artificial Sequence: Chemically synthesized oligonucleotide
ccgggcacagaaagacttc

SEQ ID NO: 9130 - DNA, 19 bp, Artificial Sequence
  Description of Artificial Sequence: Chemically synthesized oligonucleotide
gaagtctttctgtgcccgg

SEQ ID NO: 9131 - DNA, 19 bp, Artificial Sequence
  Description of Artificial Sequence: Chemically synthesized oligonucleotide
cgggcacagaaagacttcc

SEQ ID NO: 9132 - DNA, 19 bp, Artificial Sequence
  Description of Artificial Sequence: Chemically synthesized oligonucleotide
ggaagtctttctgtgcccg

SEQ ID NO: 9133 - DNA, 19 bp, Artificial Sequence
  Description of Artificial Sequence: Chemically synthesized oligonucleotide
gggcacagaaagacttcct

SEQ ID NO: 9134 - DNA, 19 bp, Artificial Sequence
  Description of Artificial Sequence: Chemically synthesized oligonucleotide
aggaagtctttctgtgccc

SEQ ID NO: 9135 - DNA, 19 bp, Artificial Sequence
  Description of Artificial Sequence: Chemically synthesized oligonucleotide
ggcacagaaagacttcctt

SEQ ID NO: 9136 - DNA, 19 bp, Artificial Sequence
  Description of Artificial Sequence: Chemically synthesized oligonucleotide
aaggaagtctttctgtgcc

SEQ ID NO: 9137 - DNA, 19 bp, Artificial Sequence
  Description of Artificial Sequence: Chemically synthesized oligonucleotide
gcacagaaagacttccttt

SEQ ID NO: 9138 - DNA, 19 bp, Artificial Sequence
  Description of Artificial Sequence: Chemically synthesized oligonucleotide
aaaggaagtctttctgtgc

SEQ ID NO: 9139 - DNA, 19 bp, Artificial Sequence
  Description of Artificial Sequence: Chemically synthesized oligonucleotide
cacagaaagacttcctttc

SEQ ID NO: 9140 - DNA, 19 bp, Artificial Sequence
  Description of Artificial Sequence: Chemically synthesized oligonucleotide
gaaaggaagtctttctgtg

SEQ ID NO: 9141 - DNA, 19 bp, Artificial Sequence
  Description of Artificial Sequence: Chemically synthesized oligonucleotide
acagaaagacttcctttca

SEQ ID NO: 9142 - DNA, 19 bp, Artificial Sequence
  Description of Artificial Sequence: Chemically synthesized oligonucleotide
tgaaaggaagtctttctgt

SEQ ID NO: 9143 - DNA, 19 bp, Artificial Sequence
  Description of Artificial Sequence: Chemically synthesized oligonucleotide
cagaaagacttcctttcag

SEQ ID NO: 9144 - DNA, 19 bp, Artificial Sequence
  Description of Artificial Sequence: Chemically synthesized oligonucleotide
ctgaaaggaagtctttctg

SEQ ID NO: 9145 - DNA, 19 bp, Artificial Sequence
  Description of Artificial Sequence: Chemically synthesized oligonucleotide
agaaagacttcctttcagg

SEQ ID NO: 9146 - DNA, 19 bp, Artificial Sequence
  Description of Artificial Sequence: Chemically synthesized oligonucleotide
cctgaaaggaagtctttct

SEQ ID NO: 9147 - DNA, 19 bp, Artificial Sequence
  Description of Artificial Sequence: Chemically synthesized oligonucleotide
gaaagacttcctttcaggc

SEQ ID NO: 9148 - DNA, 19 bp, Artificial Sequence
  Description of Artificial Sequence: Chemically synthesized oligonucleotide
gcctgaaaggaagtctttc

SEQ ID NO: 9149 - DNA, 19 bp, Artificial Sequence
  Description of Artificial Sequence: Chemically synthesized oligonucleotide
aaagacttcctttcaggcc

SEQ ID NO: 9150 - DNA, 19 bp, Artificial Sequence
  Description of Artificial Sequence: Chemically synthesized oligonucleotide
ggcctgaaaggaagtcttt

SEQ ID NO: 9151 - DNA, 19 bp, Artificial Sequence
  Description of Artificial Sequence: Chemically synthesized oligonucleotide
aagacttcctttcaggcct

SEQ ID NO: 9152 - DNA, 19 bp, Artificial Sequence
  Description of Artificial Sequence: Chemically synthesized oligonucleotide
aggcctgaaaggaagtctt

SEQ ID NO: 9153 - DNA, 19 bp, Artificial Sequence
  Description of Artificial Sequence: Chemically synthesized oligonucleotide
agacttcctttcaggcctg

SEQ ID NO: 9154 - DNA, 19 bp, Artificial Sequence
  Description of Artificial Sequence: Chemically synthesized oligonucleotide
caggcctgaaaggaagtct

SEQ ID NO: 9155 - DNA, 19 bp, Artificial Sequence
  Description of Artificial Sequence: Chemically synthesized oligonucleotide
gacttcctttcaggcctgg

SEQ ID NO: 9156 - DNA, 19 bp, Artificial Sequence
  Description of Artificial Sequence: Chemically synthesized oligonucleotide
ccaggcctgaaaggaagtc

SEQ ID NO: 9157 - DNA, 19 bp, Artificial Sequence
  Description of Artificial Sequence: Chemically synthesized oligonucleotide
acttcctttcaggcctgga

SEQ ID NO: 9158 - DNA, 19 bp, Artificial Sequence
  Description of Artificial Sequence: Chemically synthesized oligonucleotide
tccaggcctgaaaggaagt

SEQ ID NO: 9159 - DNA, 19 bp, Artificial Sequence
  Description of Artificial Sequence: Chemically synthesized oligonucleotide
cttcctttcaggcctggac

SEQ ID NO: 9160 - DNA, 19 bp, Artificial Sequence
  Description of Artificial Sequence: Chemically synthesized oligonucleotide
gtccaggcctgaaaggaag

SEQ ID NO: 9161 - DNA, 19 bp, Artificial Sequence
  Description of Artificial Sequence: Chemically synthesized oligonucleotide
ttcctttcaggcctggacg

SEQ ID NO: 9162 - DNA, 19 bp, Artificial Sequence
  Description of Artificial Sequence: Chemically synthesized oligonucleotide
cgtccaggcctgaaaggaa

SEQ ID NO: 9163 - DNA, 19 bp, Artificial Sequence
  Description of Artificial Sequence: Chemically synthesized oligonucleotide
tcctttcaggcctggacgg

SEQ ID NO: 9164 - DNA, 19 bp, Artificial Sequence
  Description of Artificial Sequence: Chemically synthesized oligonucleotide
ccgtccaggcctgaaagga

SEQ ID NO: 9165 - DNA, 19 bp, Artificial Sequence
  Description of Artificial Sequence: Chemically synthesized oligonucleotide
cctttcaggcctggacggg

SEQ ID NO: 9166 - DNA, 19 bp, Artificial Sequence
  Description of Artificial Sequence: Chemically synthesized oligonucleotide
cccgtccaggcctgaaagg

SEQ ID NO: 9167 - DNA, 19 bp, Artificial Sequence
  Description of Artificial Sequence: Chemically synthesized oligonucleotide
ctttcaggcctggacgggg

SEQ ID NO: 9168 - DNA, 19 bp, Artificial Sequence
  Description of Artificial Sequence: Chemically synthesized oligonucleotide
ccccgtccaggcctgaaag

SEQ ID NO: 9169 - DNA, 19 bp, Artificial Sequence
  Description of Artificial Sequence: Chemically synthesized oligonucleotide
tttcaggcctggacgggga

SEQ ID NO: 9170 - DNA, 19 bp, Artificial Sequence
  Description of Artificial Sequence: Chemically synthesized oligonucleotide
tccccgtccaggcctgaaa

SEQ ID NO: 9171 - DNA, 19 bp, Artificial Sequence
  Description of Artificial Sequence: Chemically synthesized oligonucleotide
ttcaggcctggacggggag

SEQ ID NO: 9172 - DNA, 19 bp, Artificial Sequence
  Description of Artificial Sequence: Chemically synthesized oligonucleotide
ctccccgtccaggcctgaa

SEQ ID NO: 9173 - DNA, 19 bp, Artificial Sequence
  Description of Artificial Sequence: Chemically synthesized oligonucleotide
tcaggcctggacggggagg

SEQ ID NO: 9174 - DNA, 19 bp, Artificial Sequence
  Description of Artificial Sequence: Chemically synthesized oligonucleotide
cctccccgtccaggcctga

SEQ ID NO: 9175 - DNA, 19 bp, Artificial Sequence
  Description of Artificial Sequence: Chemically synthesized oligonucleotide
caggcctggacggggaggg

SEQ ID NO: 9176 - DNA, 19 bp, Artificial Sequence
  Description of Artificial Sequence: Chemically synthesized oligonucleotide
ccctccccgtccaggcctg

SEQ ID NO: 9177 - DNA, 19 bp, Artificial Sequence
  Description of Artificial Sequence: Chemically synthesized oligonucleotide
aggcctggacggggagggg

SEQ ID NO: 9178 - DNA, 19 bp, Artificial Sequence
  Description of Artificial Sequence: Chemically synthesized oligonucleotide
cccctccccgtccaggcct

SEQ ID NO: 9179 - DNA, 19 bp, Artificial Sequence
  Description of Artificial Sequence: Chemically synthesized oligonucleotide
ggcctggacggggaggggc

SEQ ID NO: 9180 - DNA, 19 bp, Artificial Sequence
  Description of Artificial Sequence: Chemically synthesized oligonucleotide
gcccctccccgtccaggcc

SEQ ID NO: 9181 - DNA, 19 bp, Artificial Sequence
  Description of Artificial Sequence: Chemically synthesized oligonucleotide
gcctggacggggaggggct

SEQ ID NO: 9182 - DNA, 19 bp, Artificial Sequence
  Description of Artificial Sequence: Chemically synthesized oligonucleotide
agcccctccccgtccaggc

SEQ ID NO: 9183 - DNA, 19 bp, Artificial Sequence
  Description of Artificial Sequence: Chemically synthesized oligonucleotide
cctggacggggaggggctc

SEQ ID NO: 9184 - DNA, 19 bp, Artificial Sequence
  Description of Artificial Sequence: Chemically synthesized oligonucleotide
gagcccctccccgtccagg

SEQ ID NO: 9185 - DNA, 19 bp, Artificial Sequence
  Description of Artificial Sequence: Chemically synthesized oligonucleotide
ctggacggggaggggctct

SEQ ID NO: 9186 - DNA, 19 bp, Artificial Sequence
  Description of Artificial Sequence: Chemically synthesized oligonucleotide
agagcccctccccgtccag

SEQ ID NO: 9187 - DNA, 19 bp, Artificial Sequence
  Description of Artificial Sequence: Chemically synthesized oligonucleotide
tggacggggaggggctctg

SEQ ID NO: 9188 - DNA, 19 bp, Artificial Sequence
  Description of Artificial Sequence: Chemically synthesized oligonucleotide
cagagcccctccccgtcca

SEQ ID NO: 9189 - DNA, 19 bp, Artificial Sequence
  Description of Artificial Sequence: Chemically synthesized oligonucleotide
ggacggggaggggctctgg

SEQ ID NO: 9190 - DNA, 19 bp, Artificial Sequence
  Description of Artificial Sequence: Chemically synthesized oligonucleotide
ccagagcccctccccgtcc

SEQ ID NO: 9191 - DNA, 19 bp, Artificial Sequence
  Description of Artificial Sequence: Chemically synthesized oligonucleotide
gacggggaggggctctggt

SEQ ID NO: 9192 - DNA, 19 bp, Artificial Sequence
  Description of Artificial Sequence: Chemically synthesized oligonucleotide
accagagcccctccccgtc

SEQ ID NO: 9193 - DNA, 19 bp, Artificial Sequence
  Description of Artificial Sequence: Chemically synthesized oligonucleotide
acggggaggggctctggtc

SEQ ID NO: 9194 - DNA, 19 bp, Artificial Sequence
  Description of Artificial Sequence: Chemically synthesized oligonucleotide
gaccagagcccctccccgt

SEQ ID NO: 9195 - DNA, 19 bp, Artificial Sequence
  Description of Artificial Sequence: Chemically synthesized oligonucleotide
cggggaggggctctggtct

SEQ ID NO: 9196 - DNA, 19 bp, Artificial Sequence
  Description of Artificial Sequence: Chemically synthesized oligonucleotide
agaccagagcccctccccg

SEQ ID NO: 9197 - DNA, 19 bp, Artificial Sequence
  Description of Artificial Sequence: Chemically synthesized oligonucleotide
ggggaggggctctggtctc

SEQ ID NO: 9198 - DNA, 19 bp, Artificial Sequence
  Description of Artificial Sequence: Chemically synthesized oligonucleotide
gagaccagagcccctcccc

SEQ ID NO: 9199 - DNA, 19 bp, Artificial Sequence
  Description of Artificial Sequence: Chemically synthesized oligonucleotide
gggaggggctctggtctcc

SEQ ID NO: 9200 - DNA, 19 bp, Artificial Sequence
  Description of Artificial Sequence: Chemically synthesized oligonucleotide
ggagaccagagcccctccc

SEQ ID NO: 9201 - DNA, 19 bp, Artificial Sequence
  Description of Artificial Sequence: Chemically synthesized oligonucleotide
ggaggggctctggtctccg

SEQ ID NO: 9202 - DNA, 19 bp, Artificial Sequence
  Description of Artificial Sequence: Chemically synthesized oligonucleotide
cggagaccagagcccctcc

SEQ ID NO: 9203 - DNA, 19 bp, Artificial Sequence
  Description of Artificial Sequence: Chemically synthesized oligonucleotide
gaggggctctggtctccgg

SEQ ID NO: 9204 - DNA, 19 bp, Artificial Sequence
  Description of Artificial Sequence: Chemically synthesized oligonucleotide
ccggagaccagagcccctc

SEQ ID NO: 9205 - DNA, 19 bp, Artificial Sequence
  Description of Artificial Sequence: Chemically synthesized oligonucleotide
aggggctctggtctccggg

SEQ ID NO: 9206 - DNA, 19 bp, Artificial Sequence
  Description of Artificial Sequence: Chemically synthesized oligonucleotide
cccggagaccagagcccct

SEQ ID NO: 9207 - DNA, 19 bp, Artificial Sequence
  Description of Artificial Sequence: Chemically synthesized oligonucleotide
ggggctctggtctccgggc

SEQ ID NO: 9208 - DNA, 19 bp, Artificial Sequence
  Description of Artificial Sequence: Chemically synthesized oligonucleotide
gcccggagaccagagcccc

SEQ ID NO: 9209 - DNA, 19 bp, Artificial Sequence
  Description of Artificial Sequence: Chemically synthesized oligonucleotide
gggctctggtctccgggca

SEQ ID NO: 9210 - DNA, 19 bp, Artificial Sequence
  Description of Artificial Sequence: Chemically synthesized oligonucleotide
tgcccggagaccagagccc

SEQ ID NO: 9211 - DNA, 19 bp, Artificial Sequence
  Description of Artificial Sequence: Chemically synthesized oligonucleotide
ggctctggtctccgggcag

SEQ ID NO: 9212 - DNA, 19 bp, Artificial Sequence
  Description of Artificial Sequence: Chemically synthesized oligonucleotide
ctgcccggagaccagagcc

SEQ ID NO: 9213 - DNA, 19 bp, Artificial Sequence
  Description of Artificial Sequence: Chemically synthesized oligonucleotide
gctctggtctccgggcagc

SEQ ID NO: 9214 - DNA, 19 bp, Artificial Sequence
  Description of Artificial Sequence: Chemically synthesized oligonucleotide
gctgcccggagaccagagc

SEQ ID NO: 9215 - DNA, 19 bp, Artificial Sequence
  Description of Artificial Sequence: Chemically synthesized oligonucleotide
ctctggtctccgggcagcc

SEQ ID NO: 9216 - DNA, 19 bp, Artificial Sequence
  Description of Artificial Sequence: Chemically synthesized oligonucleotide
ggctgcccggagaccagag

SEQ ID NO: 9217 - DNA, 19 bp, Artificial Sequence
  Description of Artificial Sequence: Chemically synthesized oligonucleotide
tctggtctccgggcagcca

SEQ ID NO: 9218 - DNA, 19 bp, Artificial Sequence
  Description of Artificial Sequence: Chemically synthesized oligonucleotide
tggctgcccggagaccaga

SEQ ID NO: 9219 - DNA, 19 bp, Artificial Sequence
  Description of Artificial Sequence: Chemically synthesized oligonucleotide
ctggtctccgggcagccag

SEQ ID NO: 9220 - DNA, 19 bp, Artificial Sequence
  Description of Artificial Sequence: Chemically synthesized oligonucleotide
ctggctgcccggagaccag

SEQ ID NO: 9221 - DNA, 19 bp, Artificial Sequence
  Description of Artificial Sequence: Chemically synthesized oligonucleotide
tggtctccgggcagccagg

SEQ ID NO: 9222 - DNA, 19 bp, Artificial Sequence
  Description of Artificial Sequence: Chemically synthesized oligonucleotide
cctggctgcccggagacca

SEQ ID NO: 9223 - DNA, 19 bp, Artificial Sequence
  Description of Artificial Sequence: Chemically synthesized oligonucleotide
ggtctccgggcagccaggt

SEQ ID NO: 9224 - DNA, 19 bp, Artificial Sequence
  Description of Artificial Sequence: Chemically synthesized oligonucleotide
acctggctgcccggagacc

SEQ ID NO: 9225 - DNA, 19 bp, Artificial Sequence
  Description of Artificial Sequence: Chemically synthesized oligonucleotide
gtctccgggcagccaggtc

SEQ ID NO: 9226 - DNA, 19 bp, Artificial Sequence
  Description of Artificial Sequence: Chemically synthesized oligonucleotide
gacctggctgcccggagac

SEQ ID NO: 9227 - DNA, 19 bp, Artificial Sequence
  Description of Artificial Sequence: Chemically synthesized oligonucleotide
tctccgggcagccaggtca

SEQ ID NO: 9228 - DNA, 19 bp, Artificial Sequence
  Description of Artificial Sequence: Chemically synthesized oligonucleotide
tgacctggctgcccggaga

SEQ ID NO: 9229 - DNA, 19 bp, Artificial Sequence
  Description of Artificial Sequence: Chemically synthesized oligonucleotide
ctccgggcagccaggtcag

SEQ ID NO: 9230 - DNA, 19 bp, Artificial Sequence
  Description of Artificial Sequence: Chemically synthesized oligonucleotide
ctgacctggctgcccggag

SEQ ID NO: 9231 - DNA, 19 bp, Artificial Sequence
  Description of Artificial Sequence: Chemically synthesized oligonucleotide
tccgggcagccaggtcagc

SEQ ID NO: 9232 - DNA, 19 bp, Artificial Sequence
  Description of Artificial Sequence: Chemically synthesized oligonucleotide
gctgacctggctgcccgga

SEQ ID NO: 9233 - DNA, 19 bp, Artificial Sequence
  Description of Artificial Sequence: Chemically synthesized oligonucleotide
ccgggcagccaggtcagca

SEQ ID NO: 9234 - DNA, 19 bp, Artificial Sequence
  Description of Artificial Sequence: Chemically synthesized oligonucleotide
tgctgacctggctgcccgg

SEQ ID NO: 9235 - DNA, 19 bp, Artificial Sequence
  Description of Artificial Sequence: Chemically synthesized oligonucleotide
cgggcagccaggtcagcac

SEQ ID NO: 9236 - DNA, 19 bp, Artificial Sequence
  Description of Artificial Sequence: Chemically synthesized oligonucleotide
gtgctgacctggctgcccg

SEQ ID NO: 9237 - DNA, 19 bp, Artificial Sequence
  Description of Artificial Sequence: Chemically synthesized oligonucleotide
gggcagccaggtcagcact

SEQ ID NO: 9238 - DNA, 19 bp, Artificial Sequence
  Description of Artificial Sequence: Chemically synthesized oligonucleotide
agtgctgacctggctgccc

SEQ ID NO: 9239 - DNA, 19 bp, Artificial Sequence
  Description of Artificial Sequence: Chemically synthesized oligonucleotide
ggcagccaggtcagcactg

SEQ ID NO: 9240 - DNA, 19 bp, Artificial Sequence
  Description of Artificial Sequence: Chemically synthesized oligonucleotide
cagtgctgacctggctgcc

SEQ ID NO: 9241 - DNA, 19 bp, Artificial Sequence
  Description of Artificial Sequence: Chemically synthesized oligonucleotide
gcagccaggtcagcactgt

SEQ ID NO: 9242 - DNA, 19 bp, Artificial Sequence
  Description of Artificial Sequence: Chemically synthesized oligonucleotide
acagtgctgacctggctgc

SEQ ID NO: 9243 - DNA, 19 bp, Artificial Sequence
  Description of Artificial Sequence: Chemically synthesized oligonucleotide
cagccaggtcagcactgtg

SEQ ID NO: 9244 - DNA, 19 bp, Artificial Sequence
  Description of Artificial Sequence: Chemically synthesized oligonucleotide
cacagtgctgacctggctg

SEQ ID NO: 9245 - DNA, 19 bp, Artificial Sequence
  Description of Artificial Sequence: Chemically synthesized oligonucleotide
agccaggtcagcactgtgt

SEQ ID NO: 9246 - DNA, 19 bp, Artificial Sequence
  Description of Artificial Sequence: Chemically synthesized oligonucleotide
acacagtgctgacctggct

SEQ ID NO: 9247 - DNA, 19 bp, Artificial Sequence
  Description of Artificial Sequence: Chemically synthesized oligonucleotide
gccaggtcagcactgtgtg

SEQ ID NO: 9248 - DNA, 19 bp, Artificial Sequence
  Description of Artificial Sequence: Chemically synthesized oligonucleotide
cacacagtgctgacctggc

SEQ ID NO: 9249 - DNA, 19 bp, Artificial Sequence
  Description of Artificial Sequence: Chemically synthesized oligonucleotide
ccaggtcagcactgtgtgg

SEQ ID NO: 9250 - DNA, 19 bp, Artificial Sequence
  Description of Artificial Sequence: Chemically synthesized oligonucleotide
ccacacagtgctgacctgg

SEQ ID NO: 9251 - DNA, 19 bp, Artificial Sequence
  Description of Artificial Sequence: Chemically synthesized oligonucleotide
caggtcagcactgtgtggc

SEQ ID NO: 9252 - DNA, 19 bp, Artificial Sequence
  Description of Artificial Sequence: Chemically synthesized oligonucleotide
gccacacagtgctgacctg

SEQ ID NO: 9253 - DNA, 19 bp, Artificial Sequence
  Description of Artificial Sequence: Chemically synthesized oligonucleotide
aggtcagcactgtgtggca

SEQ ID NO: 9254 - DNA, 19 bp, Artificial Sequence
  Description of Artificial Sequence: Chemically synthesized oligonucleotide
tgccacacagtgctgacct

SEQ ID NO: 9255 - DNA, 19 bp, Artificial Sequence
  Description of Artificial Sequence: Chemically synthesized oligonucleotide
ggtcagcactgtgtggcac

SEQ ID NO: 9256 - DNA, 19 bp, Artificial Sequence
  Description of Artificial Sequence: Chemically synthesized oligonucleotide
gtgccacacagtgctgacc

SEQ ID NO: 9257 - DNA, 19 bp, Artificial Sequence
  Description of Artificial Sequence: Chemically synthesized oligonucleotide
gtcagcactgtgtggcacg

SEQ ID NO: 9258 - DNA, 19 bp, Artificial Sequence
  Description of Artificial Sequence: Chemically synthesized oligonucleotide
cgtgccacacagtgctgac

SEQ ID NO: 9259 - DNA, 19 bp, Artificial Sequence
  Description of Artificial Sequence: Chemically synthesized oligonucleotide
tcagcactgtgtggcacgt

SEQ ID NO: 9260 - DNA, 19 bp, Artificial Sequence
  Description of Artificial Sequence: Chemically synthesized oligonucleotide
acgtgccacacagtgctga

SEQ ID NO: 9261 - DNA, 19 bp, Artificial Sequence
  Description of Artificial Sequence: Chemically synthesized oligonucleotide
cagcactgtgtggcacgtg

SEQ ID NO: 9262 - DNA, 19 bp, Artificial Sequence
  Description of Artificial Sequence: Chemically synthesized oligonucleotide
cacgtgccacacagtgctg

SEQ ID NO: 9263 - DNA, 19 bp, Artificial Sequence
  Description of Artificial Sequence: Chemically synthesized oligonucleotide
agcactgtgtggcacgtgt

SEQ ID NO: 9264 - DNA, 19 bp, Artificial Sequence
  Description of Artificial Sequence: Chemically synthesized oligonucleotide
acacgtgccacacagtgct

SEQ ID NO: 9265 - DNA, 19 bp, Artificial Sequence
  Description of Artificial Sequence: Chemically synthesized oligonucleotide
gcactgtgtggcacgtgtt

SEQ ID NO: 9266 - DNA, 19 bp, Artificial Sequence
  Description of Artificial Sequence: Chemically synthesized oligonucleotide
aacacgtgccacacagtgc

SEQ ID NO: 9267 - DNA, 19 bp, Artificial Sequence
  Description of Artificial Sequence: Chemically synthesized oligonucleotide
cactgtgtggcacgtgttc

SEQ ID NO: 9268 - DNA, 19 bp, Artificial Sequence
  Description of Artificial Sequence: Chemically synthesized oligonucleotide
gaacacgtgccacacagtg

SEQ ID NO: 9269 - DNA, 19 bp, Artificial Sequence
  Description of Artificial Sequence: Chemically synthesized oligonucleotide
actgtgtggcacgtgttcc

SEQ ID NO: 9270 - DNA, 19 bp, Artificial Sequence
  Description of Artificial Sequence: Chemically synthesized oligonucleotide
ggaacacgtgccacacagt

SEQ ID NO: 9271 - DNA, 19 bp, Artificial Sequence
  Description of Artificial Sequence: Chemically synthesized oligonucleotide
ctgtgtggcacgtgttccg

SEQ ID NO: 9272 - DNA, 19 bp, Artificial Sequence
  Description of Artificial Sequence: Chemically synthesized oligonucleotide
cggaacacgtgccacacag

SEQ ID NO: 9273 - DNA, 19 bp, Artificial Sequence
  Description of Artificial Sequence: Chemically synthesized oligonucleotide
tgtgtggcacgtgttccgg

SEQ ID NO: 9274 - DNA, 19 bp, Artificial Sequence
  Description of Artificial Sequence: Chemically synthesized oligonucleotide
ccggaacacgtgccacaca

SEQ ID NO: 9275 - DNA, 19 bp, Artificial Sequence
  Description of Artificial Sequence: Chemically synthesized oligonucleotide
gtgtggcacgtgttccggg

SEQ ID NO: 9276 - DNA, 19 bp, Artificial Sequence
  Description of Artificial Sequence: Chemically synthesized oligonucleotide
cccggaacacgtgccacac

SEQ ID NO: 9277 - DNA, 19 bp, Artificial Sequence
  Description of Artificial Sequence: Chemically synthesized oligonucleotide
tgtggcacgtgttccgggc

SEQ ID NO: 9278 - DNA, 19 bp, Artificial Sequence
  Description of Artificial Sequence: Chemically synthesized oligonucleotide
gcccggaacacgtgccaca

SEQ ID NO: 9279 - DNA, 19 bp, Artificial Sequence
  Description of Artificial Sequence: Chemically synthesized oligonucleotide
gtggcacgtgttccgggca

SEQ ID NO: 9280 - DNA, 19 bp, Artificial Sequence
  Description of Artificial Sequence: Chemically synthesized oligonucleotide
tgcccggaacacgtgccac

SEQ ID NO: 9281 - DNA, 19 bp, Artificial Sequence
  Description of Artificial Sequence: Chemically synthesized oligonucleotide
tggcacgtgttccgggcac

SEQ ID NO: 9282 - DNA, 19 bp, Artificial Sequence
  Description of Artificial Sequence: Chemically synthesized oligonucleotide
gtgcccggaacacgtgcca

SEQ ID NO: 9283 - DNA, 19 bp, Artificial Sequence
  Description of Artificial Sequence: Chemically synthesized oligonucleotide
ggcacgtgttccgggcaca

SEQ ID NO: 9284 - DNA, 19 bp, Artificial Sequence
  Description of Artificial Sequence: Chemically synthesized oligonucleotide
tgtgcccggaacacgtgcc

SEQ ID NO: 9285 - DNA, 19 bp, Artificial Sequence
  Description of Artificial Sequence: Chemically synthesized oligonucleotide
gcacgtgttccgggcacag

SEQ ID NO: 9286 - DNA, 19 bp, Artificial Sequence
  Description of Artificial Sequence: Chemically synthesized oligonucleotide
ctgtgcccggaacacgtgc

SEQ ID NO: 9287 - DNA, 19 bp, Artificial Sequence
  Description of Artificial Sequence: Chemically synthesized oligonucleotide
cacgtgttccgggcacagg

SEQ ID NO: 9288 - DNA, 19 bp, Artificial Sequence
  Description of Artificial Sequence: Chemically synthesized oligonucleotide
cctgtgcccggaacacgtg

SEQ ID NO: 9289 - DNA, 19 bp, Artificial Sequence
  Description of Artificial Sequence: Chemically synthesized oligonucleotide
acgtgttccgggcacagga

SEQ ID NO: 9290 - DNA, 19 bp, Artificial Sequence
  Description of Artificial Sequence: Chemically synthesized oligonucleotide
tcctgtgcccggaacacgt

SEQ ID NO: 9291 - DNA, 19 bp, Artificial Sequence
  Description of Artificial Sequence: Chemically synthesized oligonucleotide
cgtgttccgggcacaggac

SEQ ID NO: 9292 - DNA, 19 bp, Artificial Sequence
  Description of Artificial Sequence: Chemically synthesized oligonucleotide
gtcctgtgcccggaacacg

SEQ ID NO: 9293 - DNA, 19 bp, Artificial Sequence
  Description of Artificial Sequence: Chemically synthesized oligonucleotide
gtgttccgggcacaggacg

SEQ ID NO: 9294 - DNA, 19 bp, Artificial Sequence
  Description of Artificial Sequence: Chemically synthesized oligonucleotide
cgtcctgtgcccggaacac

SEQ ID NO: 9295 - DNA, 19 bp, Artificial Sequence
  Description of Artificial Sequence: Chemically synthesized oligonucleotide
tgttccgggcacaggacgc

SEQ ID NO: 9296 - DNA, 19 bp, Artificial Sequence
  Description of Artificial Sequence: Chemically synthesized oligonucleotide
gcgtcctgtgcccggaaca

SEQ ID NO: 9297 - DNA, 19 bp, Artificial Sequence
  Description of Artificial Sequence: Chemically synthesized oligonucleotide
gttccgggcacaggacgcc

SEQ ID NO: 9298 - DNA, 19 bp, Artificial Sequence
  Description of Artificial Sequence: Chemically synthesized oligonucleotide
ggcgtcctgtgcccggaac

SEQ ID NO: 9299 - DNA, 19 bp, Artificial Sequence
  Description of Artificial Sequence: Chemically synthesized oligonucleotide
ttccgggcacaggacgccc

SEQ ID NO: 9300 - DNA, 19 bp, Artificial Sequence
  Description of Artificial Sequence: Chemically synthesized oligonucleotide
gggcgtcctgtgcccggaa

SEQ ID NO: 9301 - DNA, 19 bp, Artificial Sequence
  Description of Artificial Sequence: Chemically synthesized oligonucleotide
tccgggcacaggacgccca

SEQ ID NO: 9302 - DNA, 19 bp, Artificial Sequence
  Description of Artificial Sequence: Chemically synthesized oligonucleotide
tgggcgtcctgtgcccgga

SEQ ID NO: 9303 - DNA, 19 bp, Artificial Sequence
  Description of Artificial Sequence: Chemically synthesized oligonucleotide
ccgggcacaggacgcccag

SEQ ID NO: 9304 - DNA, 19 bp, Artificial Sequence
  Description of Artificial Sequence: Chemically synthesized oligonucleotide
ctgggcgtcctgtgcccgg

SEQ ID NO: 9305 - DNA, 19 bp, Artificial Sequence
  Description of Artificial Sequence: Chemically synthesized oligonucleotide
cgggcacaggacgcccagc

SEQ ID NO: 9306 - DNA, 19 bp, Artificial Sequence
  Description of Artificial Sequence: Chemically synthesized oligonucleotide
gctgggcgtcctgtgcccg

SEQ ID NO: 9307 - DNA, 19 bp, Artificial Sequence
  Description of Artificial Sequence: Chemically synthesized oligonucleotide
gggcacaggacgcccagcg

SEQ ID NO: 9308 - DNA, 19 bp, Artificial Sequence
  Description of Artificial Sequence: Chemically synthesized oligonucleotide
cgctgggcgtcctgtgccc

SEQ ID NO: 9309 - DNA, 19 bp, Artificial Sequence
  Description of Artificial Sequence: Chemically synthesized oligonucleotide
ggcacaggacgcccagcgc

SEQ ID NO: 9310 - DNA, 19 bp, Artificial Sequence
  Description of Artificial Sequence: Chemically synthesized oligonucleotide
gcgctgggcgtcctgtgcc

SEQ ID NO: 9311 - DNA, 19 bp, Artificial Sequence
  Description of Artificial Sequence: Chemically synthesized oligonucleotide
gcacaggacgcccagcgca

SEQ ID NO: 9312 - DNA, 19 bp, Artificial Sequence
  Description of Artificial Sequence: Chemically synthesized oligonucleotide
tgcgctgggcgtcctgtgc

SEQ ID NO: 9313 - DNA, 19 bp, Artificial Sequence
  Description of Artificial Sequence: Chemically synthesized oligonucleotide
cacaggacgcccagcgcat

SEQ ID NO: 9314 - DNA, 19 bp, Artificial Sequence
  Description of Artificial Sequence: Chemically synthesized oligonucleotide
atgcgctgggcgtcctgtg

SEQ ID NO: 9315 - DNA, 19 bp, Artificial Sequence
  Description of Artificial Sequence: Chemically synthesized oligonucleotide
acaggacgcccagcgcatc

SEQ ID NO: 9316 - DNA, 19 bp, Artificial Sequence
  Description of Artificial Sequence: Chemically synthesized oligonucleotide
gatgcgctgggcgtcctgt

SEQ ID NO: 9317 - DNA, 19 bp, Artificial Sequence
  Description of Artificial Sequence: Chemically synthesized oligonucleotide
caggacgcccagcgcatcc

SEQ ID NO: 9318 - DNA, 19 bp, Artificial Sequence
  Description of Artificial Sequence: Chemically synthesized oligonucleotide
ggatgcgctgggcgtcctg

SEQ ID NO: 9319 - DNA, 19 bp, Artificial Sequence
  Description of Artificial Sequence: Chemically synthesized oligonucleotide
aggacgcccagcgcatccg

SEQ ID NO: 9320 - DNA, 19 bp, Artificial Sequence
  Description of Artificial Sequence: Chemically synthesized oligonucleotide
cggatgcgctgggcgtcct

SEQ ID NO: 9321 - DNA, 19 bp, Artificial Sequence
  Description of Artificial Sequence: Chemically synthesized oligonucleotide
ggacgcccagcgcatccgc

SEQ ID NO: 9322 - DNA, 19 bp, Artificial Sequence
  Description of Artificial Sequence: Chemically synthesized oligonucleotide
gcggatgcgctgggcgtcc

SEQ ID NO: 9323 - DNA, 19 bp, Artificial Sequence
  Description of Artificial Sequence: Chemically synthesized oligonucleotide
gacgcccagcgcatccgcc

SEQ ID NO: 9324 - DNA, 19 bp, Artificial Sequence
  Description of Artificial Sequence: Chemically synthesized oligonucleotide
ggcggatgcgctgggcgtc

SEQ ID NO: 9325 - DNA, 19 bp, Artificial Sequence
  Description of Artificial Sequence: Chemically synthesized oligonucleotide
acgcccagcgcatccgccg

SEQ ID NO: 9326 - DNA, 19 bp, Artificial Sequence
  Description of Artificial Sequence: Chemically synthesized oligonucleotide
cggcggatgcgctgggcgt

SEQ ID NO: 9327 - DNA, 19 bp, Artificial Sequence
  Description of Artificial Sequence: Chemically synthesized oligonucleotide
cgcccagcgcatccgccgc

SEQ ID NO: 9328 - DNA, 19 bp, Artificial Sequence
  Description of Artificial Sequence: Chemically synthesized oligonucleotide
gcggcggatgcgctgggcg

SEQ ID NO: 9329 - DNA, 19 bp, Artificial Sequence
  Description of Artificial Sequence: Chemically synthesized oligonucleotide
gcccagcgcatccgccgct

SEQ ID NO: 9330 - DNA, 19 bp, Artificial Sequence
  Description of Artificial Sequence: Chemically synthesized oligonucleotide
agcggcggatgcgctgggc

SEQ ID NO: 9331 - DNA, 19 bp, Artificial Sequence
  Description of Artificial Sequence: Chemically synthesized oligonucleotide
cccagcgcatccgccgctt

SEQ ID NO: 9332 - DNA, 19 bp, Artificial Sequence
  Description of Artificial Sequence: Chemically synthesized oligonucleotide
aagcggcggatgcgctggg

SEQ ID NO: 9333 - DNA, 19 bp, Artificial Sequence
  Description of Artificial Sequence: Chemically synthesized oligonucleotide
ccagcgcatccgccgcttt

SEQ ID NO: 9334 - DNA, 19 bp, Artificial Sequence
  Description of Artificial Sequence: Chemically synthesized oligonucleotide
aaagcggcggatgcgctgg

SEQ ID NO: 9335 - DNA, 19 bp, Artificial Sequence
  Description of Artificial Sequence: Chemically synthesized oligonucleotide
cagcgcatccgccgctttc

SEQ ID NO: 9336 - DNA, 19 bp, Artificial Sequence
  Description of Artificial Sequence: Chemically synthesized oligonucleotide
gaaagcggcggatgcgctg

SEQ ID NO: 9337 - DNA, 19 bp, Artificial Sequence
  Description of Artificial Sequence: Chemically synthesized oligonucleotide
agcgcatccgccgctttct

SEQ ID NO: 9338 - DNA, 19 bp, Artificial Sequence
  Description of Artificial Sequence: Chemically synthesized oligonucleotide
agaaagcggcggatgcgct

SEQ ID NO: 9339 - DNA, 19 bp, Artificial Sequence
  Description of Artificial Sequence: Chemically synthesized oligonucleotide
gcgcatccgccgctttctc

SEQ ID NO: 9340 - DNA, 19 bp, Artificial Sequence
  Description of Artificial Sequence: Chemically synthesized oligonucleotide
gagaaagcggcggatgcgc

SEQ ID NO: 9341 - DNA, 19 bp, Artificial Sequence
  Description of Artificial Sequence: Chemically synthesized oligonucleotide
cgcatccgccgctttctcc

SEQ ID NO: 9342 - DNA, 19 bp, Artificial Sequence
  Description of Artificial Sequence: Chemically synthesized oligonucleotide
ggagaaagcggcggatgcg

SEQ ID NO: 9343 - DNA, 19 bp, Artificial Sequence
  Description of Artificial Sequence: Chemically synthesized oligonucleotide
gcatccgccgctttctcca

SEQ ID NO: 9344 - DNA, 19 bp, Artificial Sequence
  Description of Artificial Sequence: Chemically synthesized oligonucleotide
tggagaaagcggcggatgc

SEQ ID NO: 9345 - DNA, 19 bp, Artificial Sequence
  Description of Artificial Sequence: Chemically synthesized oligonucleotide
catccgccgctttctccag

SEQ ID NO: 9346 - DNA, 19 bp, Artificial Sequence
  Description of Artificial Sequence: Chemically synthesized oligonucleotide
ctggagaaagcggcggatg

SEQ ID NO: 9347 - DNA, 19 bp, Artificial Sequence
  Description of Artificial Sequence: Chemically synthesized oligonucleotide
atccgccgctttctccaga

SEQ ID NO: 9348 - DNA, 19 bp, Artificial Sequence
  Description of Artificial Sequence: Chemically synthesized oligonucleotide
tctggagaaagcggcggat

SEQ ID NO: 9349 - DNA, 19 bp, Artificial Sequence
  Description of Artificial Sequence: Chemically synthesized oligonucleotide
tccgccgctttctccagat

SEQ ID NO: 9350 - DNA, 19 bp, Artificial Sequence
  Description of Artificial Sequence: Chemically synthesized oligonucleotide
atctggagaaagcggcgga

SEQ ID NO: 9351 - DNA, 19 bp, Artificial Sequence
  Description of Artificial Sequence: Chemically synthesized oligonucleotide
ccgccgctttctccagatg

SEQ ID NO: 9352 - DNA, 19 bp, Artificial Sequence
  Description of Artificial Sequence: Chemically synthesized oligonucleotide
catctggagaaagcggcgg

SEQ ID NO: 9353 - DNA, 19 bp, Artificial Sequence
  Description of Artificial Sequence: Chemically synthesized oligonucleotide
cgccgctttctccagatgg

SEQ ID NO: 9354 - DNA, 19 bp, Artificial Sequence
  Description of Artificial Sequence: Chemically synthesized oligonucleotide
ccatctggagaaagcggcg

SEQ ID NO: 9355 - DNA, 19 bp, Artificial Sequence
  Description of Artificial Sequence: Chemically synthesized oligonucleotide
gccgctttctccagatggt

SEQ ID NO: 9356 - DNA, 19 bp, Artificial Sequence
  Description of Artificial Sequence: Chemically synthesized oligonucleotide
accatctggagaaagcggc

SEQ ID NO: 9357 - DNA, 19 bp, Artificial Sequence
  Description of Artificial Sequence: Chemically synthesized oligonucleotide
ccgctttctccagatggtg

SEQ ID NO: 9358 - DNA, 19 bp, Artificial Sequence
  Description of Artificial Sequence: Chemically synthesized oligonucleotide
caccatctggagaaagcgg

SEQ ID NO: 9359 - DNA, 19 bp, Artificial Sequence
  Description of Artificial Sequence: Chemically synthesized oligonucleotide
cgctttctccagatggtgt

SEQ ID NO: 9360 - DNA, 19 bp, Artificial Sequence
  Description of Artificial Sequence: Chemically synthesized oligonucleotide
acaccatctggagaaagcg

SEQ ID NO: 9361 - DNA, 19 bp, Artificial Sequence
  Description of Artificial Sequence: Chemically synthesized oligonucleotide
gctttctccagatggtgtg

SEQ ID NO: 9362 - DNA, 19 bp, Artificial Sequence
  Description of Artificial Sequence: Chemically synthesized oligonucleotide
cacaccatctggagaaagc

SEQ ID NO: 9363 - DNA, 19 bp, Artificial Sequence
  Description of Artificial Sequence: Chemically synthesized oligonucleotide
ctttctccagatggtgtgc

SEQ ID NO: 9364 - DNA, 19 bp, Artificial Sequence
  Description of Artificial Sequence: Chemically synthesized oligonucleotide
gcacaccatctggagaaag

SEQ ID NO: 9365 - DNA, 19 bp, Artificial Sequence
  Description of Artificial Sequence: Chemically synthesized oligonucleotide
tttctccagatggtgtgcc

SEQ ID NO: 9366 - DNA, 19 bp, Artificial Sequence
  Description of Artificial Sequence: Chemically synthesized oligonucleotide
ggcacaccatctggagaaa

SEQ ID NO: 9367 - DNA, 19 bp, Artificial Sequence
  Description of Artificial Sequence: Chemically synthesized oligonucleotide
ttctccagatggtgtgccc

SEQ ID NO: 9368 - DNA, 19 bp, Artificial Sequence
  Description of Artificial Sequence: Chemically synthesized oligonucleotide
gggcacaccatctggagaa

SEQ ID NO: 9369 - DNA, 19 bp, Artificial Sequence
  Description of Artificial Sequence: Chemically synthesized oligonucleotide
tctccagatggtgtgcccg

SEQ ID NO: 9370 - DNA, 19 bp, Artificial Sequence
  Description of Artificial Sequence: Chemically synthesized oligonucleotide
cgggcacaccatctggaga

SEQ ID NO: 9371 - DNA, 19 bp, Artificial Sequence
  Description of Artificial Sequence: Chemically synthesized oligonucleotide
ctccagatggtgtgcccgg

SEQ ID NO: 9372 - DNA, 19 bp, Artificial Sequence
  Description of Artificial Sequence: Chemically synthesized oligonucleotide
ccgggcacaccatctggag

SEQ ID NO: 9373 - DNA, 19 bp, Artificial Sequence
  Description of Artificial Sequence: Chemically synthesized oligonucleotide
tccagatggtgtgcccggc

SEQ ID NO: 9374 - DNA, 19 bp, Artificial Sequence
  Description of Artificial Sequence: Chemically synthesized oligonucleotide
gccgggcacaccatctgga

SEQ ID NO: 9375 - DNA, 19 bp, Artificial Sequence
  Description of Artificial Sequence: Chemically synthesized oligonucleotide
ccagatggtgtgcccggcc

SEQ ID NO: 9376 - DNA, 19 bp, Artificial Sequence
  Description of Artificial Sequence: Chemically synthesized oligonucleotide
ggccgggcacaccatctgg

SEQ ID NO: 9377 - DNA, 19 bp, Artificial Sequence
  Description of Artificial Sequence: Chemically synthesized oligonucleotide
cagatggtgtgcccggccg

SEQ ID NO: 9378 - DNA, 19 bp, Artificial Sequence
  Description of Artificial Sequence: Chemically synthesized oligonucleotide
cggccgggcacaccatctg

SEQ ID NO: 9379 - DNA, 19 bp, Artificial Sequence
  Description of Artificial Sequence: Chemically synthesized oligonucleotide
agatggtgtgcccggccgg

SEQ ID NO: 9380 - DNA, 19 bp, Artificial Sequence
  Description of Artificial Sequence: Chemically synthesized oligonucleotide
ccggccgggcacaccatct

SEQ ID NO: 9381 - DNA, 19 bp, Artificial Sequence
  Description of Artificial Sequence: Chemically synthesized oligonucleotide
gatggtgtgcccggccggg

SEQ ID NO: 9382 - DNA, 19 bp, Artificial Sequence
  Description of Artificial Sequence: Chemically synthesized oligonucleotide
cccggccgggcacaccatc

SEQ ID NO: 9383 - DNA, 19 bp, Artificial Sequence
  Description of Artificial Sequence: Chemically synthesized oligonucleotide
atggtgtgcccggccgggg

SEQ ID NO: 9384 - DNA, 19 bp, Artificial Sequence
  Description of Artificial Sequence: Chemically synthesized oligonucleotide
ccccggccgggcacaccat

SEQ ID NO: 9385 - DNA, 19 bp, Artificial Sequence
  Description of Artificial Sequence: Chemically synthesized oligonucleotide
tggtgtgcccggccggggc

SEQ ID NO: 9386 - DNA, 19 bp, Artificial Sequence
  Description of Artificial Sequence: Chemically synthesized oligonucleotide
gccccggccgggcacacca

SEQ ID NO: 9387 - DNA, 19 bp, Artificial Sequence
  Description of Artificial Sequence: Chemically synthesized oligonucleotide
ggtgtgcccggccggggca

SEQ ID NO: 9388 - DNA, 19 bp, Artificial Sequence
  Description of Artificial Sequence: Chemically synthesized oligonucleotide
tgccccggccgggcacacc

SEQ ID NO: 9389 - DNA, 19 bp, Artificial Sequence
  Description of Artificial Sequence: Chemically synthesized oligonucleotide
gtgtgcccggccggggcag

SEQ ID NO: 9390 - DNA, 19 bp, Artificial Sequence
  Description of Artificial Sequence: Chemically synthesized oligonucleotide
ctgccccggccgggcacac

SEQ ID NO: 9391 - DNA, 19 bp, Artificial Sequence
  Description of Artificial Sequence: Chemically synthesized oligonucleotide
tgtgcccggccggggcagg

SEQ ID NO: 9392 - DNA, 19 bp, Artificial Sequence
  Description of Artificial Sequence: Chemically synthesized oligonucleotide
cctgccccggccgggcaca

SEQ ID NO: 9393 - DNA, 19 bp, Artificial Sequence
  Description of Artificial Sequence: Chemically synthesized oligonucleotide
gtgcccggccggggcaggc

SEQ ID NO: 9394 - DNA, 19 bp, Artificial Sequence
  Description of Artificial Sequence: Chemically synthesized oligonucleotide
gcctgccccggccgggcac

SEQ ID NO: 9395 - DNA, 19 bp, Artificial Sequence
  Description of Artificial Sequence: Chemically synthesized oligonucleotide
tgcccggccggggcaggcg

SEQ ID NO: 9396 - DNA, 19 bp, Artificial Sequence
  Description of Artificial Sequence: Chemically synthesized oligonucleotide
cgcctgccccggccgggca

SEQ ID NO: 9397 - DNA, 19 bp, Artificial Sequence
  Description of Artificial Sequence: Chemically synthesized oligonucleotide
gcccggccggggcaggcgc

SEQ ID NO: 9398 - DNA, 19 bp, Artificial Sequence
  Description of Artificial Sequence: Chemically synthesized oligonucleotide
gcgcctgccccggccgggc

SEQ ID NO: 9399 - DNA, 19 bp, Artificial Sequence
  Description of Artificial Sequence: Chemically synthesized oligonucleotide
cccggccggggcaggcgcc

SEQ ID NO: 9400 - DNA, 19 bp, Artificial Sequence
  Description of Artificial Sequence: Chemically synthesized oligonucleotide
ggcgcctgccccggccggg

SEQ ID NO: 9401 - DNA, 19 bp, Artificial Sequence
  Description of Artificial Sequence: Chemically synthesized oligonucleotide
ccggccggggcaggcgccc

SEQ ID NO: 9402 - DNA, 19 bp, Artificial Sequence
  Description of Artificial Sequence: Chemically synthesized oligonucleotide
gggcgcctgccccggccgg

SEQ ID NO: 9403 - DNA, 19 bp, Artificial Sequence
  Description of Artificial Sequence: Chemically synthesized oligonucleotide
cggccggggcaggcgccct

SEQ ID NO: 9404 - DNA, 19 bp, Artificial Sequence
  Description of Artificial Sequence: Chemically synthesized oligonucleotide
agggcgcctgccccggccg

SEQ ID NO: 9405 - DNA, 19 bp, Artificial Sequence
  Description of Artificial Sequence: Chemically synthesized oligonucleotide
ggccggggcaggcgccctg

SEQ ID NO: 9406 - DNA, 19 bp, Artificial Sequence
  Description of Artificial Sequence: Chemically synthesized oligonucleotide
cagggcgcctgccccggcc

SEQ ID NO: 9407 - DNA, 19 bp, Artificial Sequence
  Description of Artificial Sequence: Chemically synthesized oligonucleotide
gccggggcaggcgccctgg

SEQ ID NO: 9408 - DNA, 19 bp, Artificial Sequence
  Description of Artificial Sequence: Chemically synthesized oligonucleotide
ccagggcgcctgccccggc

SEQ ID NO: 9409 - DNA, 19 bp, Artificial Sequence
  Description of Artificial Sequence: Chemically synthesized oligonucleotide
ccggggcaggcgccctgga

SEQ ID NO: 9410 - DNA, 19 bp, Artificial Sequence
  Description of Artificial Sequence: Chemically synthesized oligonucleotide
tccagggcgcctgccccgg

SEQ ID NO: 9411 - DNA, 19 bp, Artificial Sequence
  Description of Artificial Sequence: Chemically synthesized oligonucleotide
cggggcaggcgccctggag

SEQ ID NO: 9412 - DNA, 19 bp, Artificial Sequence
  Description of Artificial Sequence: Chemically synthesized oligonucleotide
ctccagggcgcctgccccg

SEQ ID NO: 9413 - DNA, 19 bp, Artificial Sequence
  Description of Artificial Sequence: Chemically synthesized oligonucleotide
ggggcaggcgccctggagc

SEQ ID NO: 9414 - DNA, 19 bp, Artificial Sequence
  Description of Artificial Sequence: Chemically synthesized oligonucleotide
gctccagggcgcctgcccc

SEQ ID NO: 9415 - DNA, 19 bp, Artificial Sequence
  Description of Artificial Sequence: Chemically synthesized oligonucleotide
gggcaggcgccctggagcc

SEQ ID NO: 9416 - DNA, 19 bp, Artificial Sequence
  Description of Artificial Sequence: Chemically synthesized oligonucleotide
ggctccagggcgcctgccc

SEQ ID NO: 9417 - DNA, 19 bp, Artificial Sequence
  Description of Artificial Sequence: Chemically synthesized oligonucleotide
ggcaggcgccctggagcct

SEQ ID NO: 9418 - DNA, 19 bp, Artificial Sequence
  Description of Artificial Sequence: Chemically synthesized oligonucleotide
aggctccagggcgcctgcc

SEQ ID NO: 9419 - DNA, 19 bp, Artificial Sequence
  Description of Artificial Sequence: Chemically synthesized oligonucleotide
gcaggcgccctggagcctg

SEQ ID NO: 9420 - DNA, 19 bp, Artificial Sequence
  Description of Artificial Sequence: Chemically synthesized oligonucleotide
caggctccagggcgcctgc

SEQ ID NO: 9421 - DNA, 19 bp, Artificial Sequence
  Description of Artificial Sequence: Chemically synthesized oligonucleotide
caggcgccctggagcctgg

SEQ ID NO: 9422 - DNA, 19 bp, Artificial Sequence
  Description of Artificial Sequence: Chemically synthesized oligonucleotide
ccaggctccagggcgcctg

SEQ ID NO: 9423 - DNA, 19 bp, Artificial Sequence
  Description of Artificial Sequence: Chemically synthesized oligonucleotide
aggcgccctggagcctggc

SEQ ID NO: 9424 - DNA, 19 bp, Artificial Sequence
  Description of Artificial Sequence: Chemically synthesized oligonucleotide
gccaggctccagggcgcct

SEQ ID NO: 9425 - DNA, 19 bp, Artificial Sequence
  Description of Artificial Sequence: Chemically synthesized oligonucleotide
ggcgccctggagcctggcg

SEQ ID NO: 9426 - DNA, 19 bp, Artificial Sequence
  Description of Artificial Sequence: Chemically synthesized oligonucleotide
cgccaggctccagggcgcc

SEQ ID NO: 9427 - DNA, 19 bp, Artificial Sequence
  Description of Artificial Sequence: Chemically synthesized oligonucleotide
gcgccctggagcctggcgc

SEQ ID NO: 9428 - DNA, 19 bp, Artificial Sequence
  Description of Artificial Sequence: Chemically synthesized oligonucleotide
gcgccaggctccagggcgc

SEQ ID NO: 9429 - DNA, 19 bp, Artificial Sequence
  Description of Artificial Sequence: Chemically synthesized oligonucleotide
cgccctggagcctggcgcc

SEQ ID NO: 9430 - DNA, 19 bp, Artificial Sequence
  Description of Artificial Sequence: Chemically synthesized oligonucleotide
ggcgccaggctccagggcg

SEQ ID NO: 9431 - DNA, 19 bp, Artificial Sequence
  Description of Artificial Sequence: Chemically synthesized oligonucleotide
gccctggagcctggcgccc

SEQ ID NO: 9432 - DNA, 19 bp, Artificial Sequence
  Description of Artificial Sequence: Chemically synthesized oligonucleotide
gggcgccaggctccagggc

SEQ ID NO: 9433 - DNA, 19 bp, Artificial Sequence
  Description of Artificial Sequence: Chemically synthesized oligonucleotide
ccctggagcctggcgcccc

SEQ ID NO: 9434 - DNA, 19 bp, Artificial Sequence
  Description of Artificial Sequence: Chemically synthesized oligonucleotide
ggggcgccaggctccaggg

SEQ ID NO: 9435 - DNA, 19 bp, Artificial Sequence
  Description of Artificial Sequence: Chemically synthesized oligonucleotide
cctggagcctggcgcccca

SEQ ID NO: 9436 - DNA, 19 bp, Artificial Sequence
  Description of Artificial Sequence: Chemically synthesized oligonucleotide
tggggcgccaggctccagg

SEQ ID NO: 9437 - DNA, 19 bp, Artificial Sequence
  Description of Artificial Sequence: Chemically synthesized oligonucleotide
ctggagcctggcgccccag

SEQ ID NO: 9438 - DNA, 19 bp, Artificial Sequence
  Description of Artificial Sequence: Chemically synthesized oligonucleotide
ctggggcgccaggctccag

SEQ ID NO: 9439 - DNA, 19 bp, Artificial Sequence
  Description of Artificial Sequence: Chemically synthesized oligonucleotide
tggagcctggcgccccagg

SEQ ID NO: 9440 - DNA, 19 bp, Artificial Sequence
  Description of Artificial Sequence: Chemically synthesized oligonucleotide
cctggggcgccaggctcca

SEQ ID NO: 9441 - DNA, 19 bp, Artificial Sequence
  Description of Artificial Sequence: Chemically synthesized oligonucleotide
ggagcctggcgccccaggc

SEQ ID NO: 9442 - DNA, 19 bp, Artificial Sequence
  Description of Artificial Sequence: Chemically synthesized oligonucleotide
gcctggggcgccaggctcc

SEQ ID NO: 9443 - DNA, 19 bp, Artificial Sequence
  Description of Artificial Sequence: Chemically synthesized oligonucleotide
gagcctggcgccccaggca

SEQ ID NO: 9444 - DNA, 19 bp, Artificial Sequence
  Description of Artificial Sequence: Chemically synthesized oligonucleotide
tgcctggggcgccaggctc

SEQ ID NO: 9445 - DNA, 19 bp, Artificial Sequence
  Description of Artificial Sequence: Chemically synthesized oligonucleotide
agcctggcgccccaggcag

SEQ ID NO: 9446 - DNA, 19 bp, Artificial Sequence
  Description of Artificial Sequence: Chemically synthesized oligonucleotide
ctgcctggggcgccaggct

SEQ ID NO: 9447 - DNA, 19 bp, Artificial Sequence
  Description of Artificial Sequence: Chemically synthesized oligonucleotide
gcctggcgccccaggcagc

SEQ ID NO: 9448 - DNA, 19 bp, Artificial Sequence
  Description of Artificial Sequence: Chemically synthesized oligonucleotide
gctgcctggggcgccaggc

SEQ ID NO: 9449 - DNA, 19 bp, Artificial Sequence
  Description of Artificial Sequence: Chemically synthesized oligonucleotide
cctggcgccccaggcagct

SEQ ID NO: 9450 - DNA, 19 bp, Artificial Sequence
  Description of Artificial Sequence: Chemically synthesized oligonucleotide
agctgcctggggcgccagg

SEQ ID NO: 9451 - DNA, 19 bp, Artificial Sequence
  Description of Artificial Sequence: Chemically synthesized oligonucleotide
ctggcgccccaggcagctg

SEQ ID NO: 9452 - DNA, 19 bp, Artificial Sequence
  Description of Artificial Sequence: Chemically synthesized oligonucleotide
cagctgcctggggcgccag

SEQ ID NO: 9453 - DNA, 19 bp, Artificial Sequence
  Description of Artificial Sequence: Chemically synthesized oligonucleotide
tggcgccccaggcagctgc

SEQ ID NO: 9454 - DNA, 19 bp, Artificial Sequence
  Description of Artificial Sequence: Chemically synthesized oligonucleotide
gcagctgcctggggcgcca

SEQ ID NO: 9455 - DNA, 19 bp, Artificial Sequence
  Description of Artificial Sequence: Chemically synthesized oligonucleotide
ggcgccccaggcagctgct

SEQ ID NO: 9456 - DNA, 19 bp, Artificial Sequence
  Description of Artificial Sequence: Chemically synthesized oligonucleotide
agcagctgcctggggcgcc

SEQ ID NO: 9457 - DNA, 19 bp, Artificial Sequence
  Description of Artificial Sequence: Chemically synthesized oligonucleotide
gcgccccaggcagctgcta

SEQ ID NO: 9458 - DNA, 19 bp, Artificial Sequence
  Description of Artificial Sequence: Chemically synthesized oligonucleotide
tagcagctgcctggggcgc

SEQ ID NO: 9459 - DNA, 19 bp, Artificial Sequence
  Description of Artificial Sequence: Chemically synthesized oligonucleotide
cgccccaggcagctgctac

SEQ ID NO: 9460 - DNA, 19 bp, Artificial Sequence
  Description of Artificial Sequence: Chemically synthesized oligonucleotide
gtagcagctgcctggggcg

SEQ ID NO: 9461 - DNA, 19 bp, Artificial Sequence
  Description of Artificial Sequence: Chemically synthesized oligonucleotide
gccccaggcagctgctacc

SEQ ID NO: 9462 - DNA, 19 bp, Artificial Sequence
  Description of Artificial Sequence: Chemically synthesized oligonucleotide
ggtagcagctgcctggggc

SEQ ID NO: 9463 - DNA, 19 bp, Artificial Sequence
  Description of Artificial Sequence: Chemically synthesized oligonucleotide
ccccaggcagctgctacct

SEQ ID NO: 9464 - DNA, 19 bp, Artificial Sequence
  Description of Artificial Sequence: Chemically synthesized oligonucleotide
aggtagcagctgcctgggg

SEQ ID NO: 9465 - DNA, 19 bp, Artificial Sequence
  Description of Artificial Sequence: Chemically synthesized oligonucleotide
cccaggcagctgctacctg

SEQ ID NO: 9466 - DNA, 19 bp, Artificial Sequence
  Description of Artificial Sequence: Chemically synthesized oligonucleotide
caggtagcagctgcctggg

SEQ ID NO: 9467 - DNA, 19 bp, Artificial Sequence
  Description of Artificial Sequence: Chemically synthesized oligonucleotide
ccaggcagctgctacctgg

SEQ ID NO: 9468 - DNA, 19 bp, Artificial Sequence
  Description of Artificial Sequence: Chemically synthesized oligonucleotide
ccaggtagcagctgcctgg

SEQ ID NO: 9469 - DNA, 19 bp, Artificial Sequence
  Description of Artificial Sequence: Chemically synthesized oligonucleotide
caggcagctgctacctgga

SEQ ID NO: 9470 - DNA, 19 bp, Artificial Sequence
  Description of Artificial Sequence: Chemically synthesized oligonucleotide
tccaggtagcagctgcctg

SEQ ID NO: 9471 - DNA, 19 bp, Artificial Sequence
  Description of Artificial Sequence: Chemically synthesized oligonucleotide
aggcagctgctacctggat

SEQ ID NO: 9472 - DNA, 19 bp, Artificial Sequence
  Description of Artificial Sequence: Chemically synthesized oligonucleotide
atccaggtagcagctgcct

SEQ ID NO: 9473 - DNA, 19 bp, Artificial Sequence
  Description of Artificial Sequence: Chemically synthesized oligonucleotide
ggcagctgctacctggatg

SEQ ID NO: 9474 - DNA, 19 bp, Artificial Sequence
  Description of Artificial Sequence: Chemically synthesized oligonucleotide
catccaggtagcagctgcc

SEQ ID NO: 9475 - DNA, 19 bp, Artificial Sequence
  Description of Artificial Sequence: Chemically synthesized oligonucleotide
gcagctgctacctggatgc

SEQ ID NO: 9476 - DNA, 19 bp, Artificial Sequence
  Description of Artificial Sequence: Chemically synthesized oligonucleotide
gcatccaggtagcagctgc

SEQ ID NO: 9477 - DNA, 19 bp, Artificial Sequence
  Description of Artificial Sequence: Chemically synthesized oligonucleotide
cagctgctacctggatgca

SEQ ID NO: 9478 - DNA, 19 bp, Artificial Sequence
  Description of Artificial Sequence: Chemically synthesized oligonucleotide
tgcatccaggtagcagctg

SEQ ID NO: 9479 - DNA, 19 bp, Artificial Sequence
  Description of Artificial Sequence: Chemically synthesized oligonucleotide
agctgctacctggatgcag

SEQ ID NO: 9480 - DNA, 19 bp, Artificial Sequence
  Description of Artificial Sequence: Chemically synthesized oligonucleotide
ctgcatccaggtagcagct

SEQ ID NO: 9481 - DNA, 19 bp, Artificial Sequence
  Description of Artificial Sequence: Chemically synthesized oligonucleotide
gctgctacctggatgcagg

SEQ ID NO: 9482 - DNA, 19 bp, Artificial Sequence
  Description of Artificial Sequence: Chemically synthesized oligonucleotide
cctgcatccaggtagcagc

SEQ ID NO: 9483 - DNA, 19 bp, Artificial Sequence
  Description of Artificial Sequence: Chemically synthesized oligonucleotide
ctgctacctggatgcaggg

SEQ ID NO: 9484 - DNA, 19 bp, Artificial Sequence
  Description of Artificial Sequence: Chemically synthesized oligonucleotide
ccctgcatccaggtagcag

SEQ ID NO: 9485 - DNA, 19 bp, Artificial Sequence
  Description of Artificial Sequence: Chemically synthesized oligonucleotide
tgctacctggatgcagggc

SEQ ID NO: 9486 - DNA, 19 bp, Artificial Sequence
  Description of Artificial Sequence: Chemically synthesized oligonucleotide
gccctgcatccaggtagca

SEQ ID NO: 9487 - DNA, 19 bp, Artificial Sequence
  Description of Artificial Sequence: Chemically synthesized oligonucleotide
gctacctggatgcagggct

SEQ ID NO: 9488 - DNA, 19 bp, Artificial Sequence
  Description of Artificial Sequence: Chemically synthesized oligonucleotide
agccctgcatccaggtagc

SEQ ID NO: 9489 - DNA, 19 bp, Artificial Sequence
  Description of Artificial Sequence: Chemically synthesized oligonucleotide
ctacctggatgcagggctg

SEQ ID NO: 9490 - DNA, 19 bp, Artificial Sequence
  Description of Artificial Sequence: Chemically synthesized oligonucleotide
cagccctgcatccaggtag

SEQ ID NO: 9491 - DNA, 19 bp, Artificial Sequence
  Description of Artificial Sequence: Chemically synthesized oligonucleotide
tacctggatgcagggctgc

SEQ ID NO: 9492 - DNA, 19 bp, Artificial Sequence
  Description of Artificial Sequence: Chemically synthesized oligonucleotide
gcagccctgcatccaggta

SEQ ID NO: 9493 - DNA, 19 bp, Artificial Sequence
  Description of Artificial Sequence: Chemically synthesized oligonucleotide
acctggatgcagggctgcg

SEQ ID NO: 9494 - DNA, 19 bp, Artificial Sequence
  Description of Artificial Sequence: Chemically synthesized oligonucleotide
cgcagccctgcatccaggt

SEQ ID NO: 9495 - DNA, 19 bp, Artificial Sequence
  Description of Artificial Sequence: Chemically synthesized oligonucleotide
cctggatgcagggctgcgg

SEQ ID NO: 9496 - DNA, 19 bp, Artificial Sequence
  Description of Artificial Sequence: Chemically synthesized oligonucleotide
ccgcagccctgcatccagg

SEQ ID NO: 9497 - DNA, 19 bp, Artificial Sequence
  Description of Artificial Sequence: Chemically synthesized oligonucleotide
ctggatgcagggctgcggc

SEQ ID NO: 9498 - DNA, 19 bp, Artificial Sequence
  Description of Artificial Sequence: Chemically synthesized oligonucleotide
gccgcagccctgcatccag

SEQ ID NO: 9499 - DNA, 19 bp, Artificial Sequence
  Description of Artificial Sequence: Chemically synthesized oligonucleotide
tggatgcagggctgcggcg

SEQ ID NO: 9500 - DNA, 19 bp, Artificial Sequence
  Description of Artificial Sequence: Chemically synthesized oligonucleotide
cgccgcagccctgcatcca

SEQ ID NO: 9501 - DNA, 19 bp, Artificial Sequence
  Description of Artificial Sequence: Chemically synthesized oligonucleotide
ggatgcagggctgcggcgg

SEQ ID NO: 9502 - DNA, 19 bp, Artificial Sequence
  Description of Artificial Sequence: Chemically synthesized oligonucleotide
ccgccgcagccctgcatcc

SEQ ID NO: 9503 - DNA, 19 bp, Artificial Sequence
  Description of Artificial Sequence: Chemically synthesized oligonucleotide
gatgcagggctgcggcggc

SEQ ID NO: 9504 - DNA, 19 bp, Artificial Sequence
  Description of Artificial Sequence: Chemically synthesized oligonucleotide
gccgccgcagccctgcatc

SEQ ID NO: 9505 - DNA, 19 bp, Artificial Sequence
  Description of Artificial Sequence: Chemically synthesized oligonucleotide
atgcagggctgcggcggcg

SEQ ID NO: 9506 - DNA, 19 bp, Artificial Sequence
  Description of Artificial Sequence: Chemically synthesized oligonucleotide
cgccgccgcagccctgcat

SEQ ID NO: 9507 - DNA, 19 bp, Artificial Sequence
  Description of Artificial Sequence: Chemically synthesized oligonucleotide
tgcagggctgcggcggcgc

SEQ ID NO: 9508 - DNA, 19 bp, Artificial Sequence
  Description of Artificial Sequence: Chemically synthesized oligonucleotide
gcgccgccgcagccctgca

SEQ ID NO: 9509 - DNA, 19 bp, Artificial Sequence
  Description of Artificial Sequence: Chemically synthesized oligonucleotide
gcagggctgcggcggcgcc

SEQ ID NO: 9510 - DNA, 19 bp, Artificial Sequence
  Description of Artificial Sequence: Chemically synthesized oligonucleotide
ggcgccgccgcagccctgc

SEQ ID NO: 9511 - DNA, 19 bp, Artificial Sequence
  Description of Artificial Sequence: Chemically synthesized oligonucleotide
cagggctgcggcggcgcct

SEQ ID NO: 9512 - DNA, 19 bp, Artificial Sequence
  Description of Artificial Sequence: Chemically synthesized oligonucleotide
aggcgccgccgcagccctg

SEQ ID NO: 9513 - DNA, 19 bp, Artificial Sequence
  Description of Artificial Sequence: Chemically synthesized oligonucleotide
agggctgcggcggcgcctg

SEQ ID NO: 9514 - DNA, 19 bp, Artificial Sequence
  Description of Artificial Sequence: Chemically synthesized oligonucleotide
caggcgccgccgcagccct

SEQ ID NO: 9515 - DNA, 19 bp, Artificial Sequence
  Description of Artificial Sequence: Chemically synthesized oligonucleotide
gggctgcggcggcgcctgc

SEQ ID NO: 9516 - DNA, 19 bp, Artificial Sequence
  Description of Artificial Sequence: Chemically synthesized oligonucleotide
gcaggcgccgccgcagccc

SEQ ID NO: 9517 - DNA, 19 bp, Artificial Sequence
  Description of Artificial Sequence: Chemically synthesized oligonucleotide
ggctgcggcggcgcctgcg

SEQ ID NO: 9518 - DNA, 19 bp, Artificial Sequence
  Description of Artificial Sequence: Chemically synthesized oligonucleotide
cgcaggcgccgccgcagcc

SEQ ID NO: 9519 - DNA, 19 bp, Artificial Sequence
  Description of Artificial Sequence: Chemically synthesized oligonucleotide
gctgcggcggcgcctgcgg

SEQ ID NO: 9520 - DNA, 19 bp, Artificial Sequence
  Description of Artificial Sequence: Chemically synthesized oligonucleotide
ccgcaggcgccgccgcagc

SEQ ID NO: 9521 - DNA, 19 bp, Artificial Sequence
  Description of Artificial Sequence: Chemically synthesized oligonucleotide
ctgcggcggcgcctgcggg

SEQ ID NO: 9522 - DNA, 19 bp, Artificial Sequence
  Description of Artificial Sequence: Chemically synthesized oligonucleotide
cccgcaggcgccgccgcag

SEQ ID NO: 9523 - DNA, 19 bp, Artificial Sequence
  Description of Artificial Sequence: Chemically synthesized oligonucleotide
tgcggcggcgcctgcggga

SEQ ID NO: 9524 - DNA, 19 bp, Artificial Sequence
  Description of Artificial Sequence: Chemically synthesized oligonucleotide
tcccgcaggcgccgccgca

SEQ ID NO: 9525 - DNA, 19 bp, Artificial Sequence
  Description of Artificial Sequence: Chemically synthesized oligonucleotide
gcggcggcgcctgcgggag

SEQ ID NO: 9526 - DNA, 19 bp, Artificial Sequence
  Description of Artificial Sequence: Chemically synthesized oligonucleotide
ctcccgcaggcgccgccgc

SEQ ID NO: 9527 - DNA, 19 bp, Artificial Sequence
  Description of Artificial Sequence: Chemically synthesized oligonucleotide
cggcggcgcctgcgggagg

SEQ ID NO: 9528 - DNA, 19 bp, Artificial Sequence
  Description of Artificial Sequence: Chemically synthesized oligonucleotide
cctcccgcaggcgccgccg

SEQ ID NO: 9529 - DNA, 19 bp, Artificial Sequence
  Description of Artificial Sequence: Chemically synthesized oligonucleotide
ggcggcgcctgcgggagga

SEQ ID NO: 9530 - DNA, 19 bp, Artificial Sequence
  Description of Artificial Sequence: Chemically synthesized oligonucleotide
tcctcccgcaggcgccgcc

SEQ ID NO: 9531 - DNA, 19 bp, Artificial Sequence
  Description of Artificial Sequence: Chemically synthesized oligonucleotide
gcggcgcctgcgggaggag

SEQ ID NO: 9532 - DNA, 19 bp, Artificial Sequence
  Description of Artificial Sequence: Chemically synthesized oligonucleotide
ctcctcccgcaggcgccgc

SEQ ID NO: 9533 - DNA, 19 bp, Artificial Sequence
  Description of Artificial Sequence: Chemically synthesized oligonucleotide
cggcgcctgcgggaggagt

SEQ ID NO: 9534 - DNA, 19 bp, Artificial Sequence
  Description of Artificial Sequence: Chemically synthesized oligonucleotide
actcctcccgcaggcgccg

SEQ ID NO: 9535 - DNA, 19 bp, Artificial Sequence
  Description of Artificial Sequence: Chemically synthesized oligonucleotide
ggcgcctgcgggaggagtg

SEQ ID NO: 9536 - DNA, 19 bp, Artificial Sequence
  Description of Artificial Sequence: Chemically synthesized oligonucleotide
cactcctcccgcaggcgcc

SEQ ID NO: 9537 - DNA, 19 bp, Artificial Sequence
  Description of Artificial Sequence: Chemically synthesized oligonucleotide
gcgcctgcgggaggagtgg

SEQ ID NO: 9538 - DNA, 19 bp, Artificial Sequence
  Description of Artificial Sequence: Chemically synthesized oligonucleotide
ccactcctcccgcaggcgc

SEQ ID NO: 9539 - DNA, 19 bp, Artificial Sequence
  Description of Artificial Sequence: Chemically synthesized oligonucleotide
cgcctgcgggaggagtggg

SEQ ID NO: 9540 - DNA, 19 bp, Artificial Sequence
  Description of Artificial Sequence: Chemically synthesized oligonucleotide
cccactcctcccgcaggcg

SEQ ID NO: 9541 - DNA, 19 bp, Artificial Sequence
  Description of Artificial Sequence: Chemically synthesized oligonucleotide
gcctgcgggaggagtgggg

SEQ ID NO: 9542 - DNA, 19 bp, Artificial Sequence
  Description of Artificial Sequence: Chemically synthesized oligonucleotide
ccccactcctcccgcaggc

SEQ ID NO: 9543 - DNA, 19 bp, Artificial Sequence
  Description of Artificial Sequence: Chemically synthesized oligonucleotide
cctgcgggaggagtggggc

SEQ ID NO: 9544 - DNA, 19 bp, Artificial Sequence
  Description of Artificial Sequence: Chemically synthesized oligonucleotide
gccccactcctcccgcagg

SEQ ID NO: 9545 - DNA, 19 bp, Artificial Sequence
  Description of Artificial Sequence: Chemically synthesized oligonucleotide
ctgcgggaggagtggggcg

SEQ ID NO: 9546 - DNA, 19 bp, Artificial Sequence
  Description of Artificial Sequence: Chemically synthesized oligonucleotide
cgccccactcctcccgcag

SEQ ID NO: 9547 - DNA, 19 bp, Artificial Sequence
  Description of Artificial Sequence: Chemically synthesized oligonucleotide
tgcgggaggagtggggcgt

SEQ ID NO: 9548 - DNA, 19 bp, Artificial Sequence
  Description of Artificial Sequence: Chemically synthesized oligonucleotide
acgccccactcctcccgca

SEQ ID NO: 9549 - DNA, 19 bp, Artificial Sequence
  Description of Artificial Sequence: Chemically synthesized oligonucleotide
gcgggaggagtggggcgtg

SEQ ID NO: 9550 - DNA, 19 bp, Artificial Sequence
  Description of Artificial Sequence: Chemically synthesized oligonucleotide
cacgccccactcctcccgc

SEQ ID NO: 9551 - DNA, 19 bp, Artificial Sequence
  Description of Artificial Sequence: Chemically synthesized oligonucleotide
cgggaggagtggggcgtga

SEQ ID NO: 9552 - DNA, 19 bp, Artificial Sequence
  Description of Artificial Sequence: Chemically synthesized oligonucleotide
tcacgccccactcctcccg

SEQ ID NO: 9553 - DNA, 19 bp, Artificial Sequence
  Description of Artificial Sequence: Chemically synthesized oligonucleotide
gggaggagtggggcgtgag

SEQ ID NO: 9554 - DNA, 19 bp, Artificial Sequence
  Description of Artificial Sequence: Chemically synthesized oligonucleotide
ctcacgccccactcctccc

SEQ ID NO: 9555 - DNA, 19 bp, Artificial Sequence
  Description of Artificial Sequence: Chemically synthesized oligonucleotide
ggaggagtggggcgtgagc

SEQ ID NO: 9556 - DNA, 19 bp, Artificial Sequence
  Description of Artificial Sequence: Chemically synthesized oligonucleotide
gctcacgccccactcctcc

SEQ ID NO: 9557 - DNA, 19 bp, Artificial Sequence
  Description of Artificial Sequence: Chemically synthesized oligonucleotide
gaggagtggggcgtgagct

SEQ ID NO: 9558 - DNA, 19 bp, Artificial Sequence
  Description of Artificial Sequence: Chemically synthesized oligonucleotide
agctcacgccccactcctc

SEQ ID NO: 9559 - DNA, 19 bp, Artificial Sequence
  Description of Artificial Sequence: Chemically synthesized oligonucleotide
aggagtggggcgtgagctg

SEQ ID NO: 9560 - DNA, 19 bp, Artificial Sequence
  Description of Artificial Sequence: Chemically synthesized oligonucleotide
cagctcacgccccactcct

SEQ ID NO: 9561 - DNA, 19 bp, Artificial Sequence
  Description of Artificial Sequence: Chemically synthesized oligonucleotide
ggagtggggcgtgagctgc

SEQ ID NO: 9562 - DNA, 19 bp, Artificial Sequence
  Description of Artificial Sequence: Chemically synthesized oligonucleotide
gcagctcacgccccactcc

SEQ ID NO: 9563 - DNA, 19 bp, Artificial Sequence
  Description of Artificial Sequence: Chemically synthesized oligonucleotide
gagtggggcgtgagctgct

SEQ ID NO: 9564 - DNA, 19 bp, Artificial Sequence
  Description of Artificial Sequence: Chemically synthesized oligonucleotide
agcagctcacgccccactc

SEQ ID NO: 9565 - DNA, 19 bp, Artificial Sequence
  Description of Artificial Sequence: Chemically synthesized oligonucleotide
agtggggcgtgagctgctg

SEQ ID NO: 9566 - DNA, 19 bp, Artificial Sequence
  Description of Artificial Sequence: Chemically synthesized oligonucleotide
cagcagctcacgccccact

SEQ ID NO: 9567 - DNA, 19 bp, Artificial Sequence
  Description of Artificial Sequence: Chemically synthesized oligonucleotide
gtggggcgtgagctgctgg

SEQ ID NO: 9568 - DNA, 19 bp, Artificial Sequence
  Description of Artificial Sequence: Chemically synthesized oligonucleotide
ccagcagctcacgccccac

SEQ ID NO: 9569 - DNA, 19 bp, Artificial Sequence
  Description of Artificial Sequence: Chemically synthesized oligonucleotide
tggggcgtgagctgctgga

SEQ ID NO: 9570 - DNA, 19 bp, Artificial Sequence
  Description of Artificial Sequence: Chemically synthesized oligonucleotide
tccagcagctcacgcccca

SEQ ID NO: 9571 - DNA, 19 bp, Artificial Sequence
  Description of Artificial Sequence: Chemically synthesized oligonucleotide
ggggcgtgagctgctggac

SEQ ID NO: 9572 - DNA, 19 bp, Artificial Sequence
  Description of Artificial Sequence: Chemically synthesized oligonucleotide
gtccagcagctcacgcccc

SEQ ID NO: 9573 - DNA, 19 bp, Artificial Sequence
  Description of Artificial Sequence: Chemically synthesized oligonucleotide
gggcgtgagctgctggacc

SEQ ID NO: 9574 - DNA, 19 bp, Artificial Sequence
  Description of Artificial Sequence: Chemically synthesized oligonucleotide
ggtccagcagctcacgccc

SEQ ID NO: 9575 - DNA, 19 bp, Artificial Sequence
  Description of Artificial Sequence: Chemically synthesized oligonucleotide
ggcgtgagctgctggaccc

SEQ ID NO: 9576 - DNA, 19 bp, Artificial Sequence
  Description of Artificial Sequence: Chemically synthesized oligonucleotide
gggtccagcagctcacgcc

SEQ ID NO: 9577 - DNA, 19 bp, Artificial Sequence
  Description of Artificial Sequence: Chemically synthesized oligonucleotide
gcgtgagctgctggaccct

SEQ ID NO: 9578 - DNA, 19 bp, Artificial Sequence
  Description of Artificial Sequence: Chemically synthesized oligonucleotide
agggtccagcagctcacgc

SEQ ID NO: 9579 - DNA, 19 bp, Artificial Sequence
  Description of Artificial Sequence: Chemically synthesized oligonucleotide
cgtgagctgctggaccctg

SEQ ID NO: 9580 - DNA, 19 bp, Artificial Sequence
  Description of Artificial Sequence: Chemically synthesized oligonucleotide
cagggtccagcagctcacg

SEQ ID NO: 9581 - DNA, 19 bp, Artificial Sequence
  Description of Artificial Sequence: Chemically synthesized oligonucleotide
gtgagctgctggaccctgc

SEQ ID NO: 9582 - DNA, 19 bp, Artificial Sequence
  Description of Artificial Sequence: Chemically synthesized oligonucleotide
gcagggtccagcagctcac

SEQ ID NO: 9583 - DNA, 19 bp, Artificial Sequence
  Description of Artificial Sequence: Chemically synthesized oligonucleotide
tgagctgctggaccctgct

SEQ ID NO: 9584 - DNA, 19 bp, Artificial Sequence
  Description of Artificial Sequence: Chemically synthesized oligonucleotide
agcagggtccagcagctca

SEQ ID NO: 9585 - DNA, 19 bp, Artificial Sequence
  Description of Artificial Sequence: Chemically synthesized oligonucleotide
gagctgctggaccctgctc

SEQ ID NO: 9586 - DNA, 19 bp, Artificial Sequence
  Description of Artificial Sequence: Chemically synthesized oligonucleotide
gagcagggtccagcagctc

SEQ ID NO: 9587 - DNA, 19 bp, Artificial Sequence
  Description of Artificial Sequence: Chemically synthesized oligonucleotide
agctgctggaccctgctcc

SEQ ID NO: 9588 - DNA, 19 bp, Artificial Sequence
  Description of Artificial Sequence: Chemically synthesized oligonucleotide
ggagcagggtccagcagct

SEQ ID NO: 9589 - DNA, 19 bp, Artificial Sequence
  Description of Artificial Sequence: Chemically synthesized oligonucleotide
gctgctggaccctgctcca

SEQ ID NO: 9590 - DNA, 19 bp, Artificial Sequence
  Description of Artificial Sequence: Chemically synthesized oligonucleotide
tggagcagggtccagcagc

SEQ ID NO: 9591 - DNA, 19 bp, Artificial Sequence
  Description of Artificial Sequence: Chemically synthesized oligonucleotide
ctgctggaccctgctccag

SEQ ID NO: 9592 - DNA, 19 bp, Artificial Sequence
  Description of Artificial Sequence: Chemically synthesized oligonucleotide
ctggagcagggtccagcag

SEQ ID NO: 9593 - DNA, 19 bp, Artificial Sequence
  Description of Artificial Sequence: Chemically synthesized oligonucleotide
tgctggaccctgctccagg

SEQ ID NO: 9594 - DNA, 19 bp, Artificial Sequence
  Description of Artificial Sequence: Chemically synthesized oligonucleotide
cctggagcagggtccagca

SEQ ID NO: 9595 - DNA, 19 bp, Artificial Sequence
  Description of Artificial Sequence: Chemically synthesized oligonucleotide
gctggaccctgctccaggc

SEQ ID NO: 9596 - DNA, 19 bp, Artificial Sequence
  Description of Artificial Sequence: Chemically synthesized oligonucleotide
gcctggagcagggtccagc

SEQ ID NO: 9597 - DNA, 19 bp, Artificial Sequence
  Description of Artificial Sequence: Chemically synthesized oligonucleotide
ctggaccctgctccaggcc

SEQ ID NO: 9598 - DNA, 19 bp, Artificial Sequence
  Description of Artificial Sequence: Chemically synthesized oligonucleotide
ggcctggagcagggtccag

SEQ ID NO: 9599 - DNA, 19 bp, Artificial Sequence
  Description of Artificial Sequence: Chemically synthesized oligonucleotide
tggaccctgctccaggccc

SEQ ID NO: 9600 - DNA, 19 bp, Artificial Sequence
  Description of Artificial Sequence: Chemically synthesized oligonucleotide
gggcctggagcagggtcca

SEQ ID NO: 9601 - DNA, 19 bp, Artificial Sequence
  Description of Artificial Sequence: Chemically synthesized oligonucleotide
ggaccctgctccaggcccc

SEQ ID NO: 9602 - DNA, 19 bp, Artificial Sequence
  Description of Artificial Sequence: Chemically synthesized oligonucleotide
ggggcctggagcagggtcc

SEQ ID NO: 9603 - DNA, 19 bp, Artificial Sequence
  Description of Artificial Sequence: Chemically synthesized oligonucleotide
gaccctgctccaggccccc

SEQ ID NO: 9604 - DNA, 19 bp, Artificial Sequence
  Description of Artificial Sequence: Chemically synthesized oligonucleotide
gggggcctggagcagggtc

SEQ ID NO: 9605 - DNA, 19 bp, Artificial Sequence
  Description of Artificial Sequence: Chemically synthesized oligonucleotide
accctgctccaggcccccg

SEQ ID NO: 9606 - DNA, 19 bp, Artificial Sequence
  Description of Artificial Sequence: Chemically synthesized oligonucleotide
cgggggcctggagcagggt

SEQ ID NO: 9607 - DNA, 19 bp, Artificial Sequence
  Description of Artificial Sequence: Chemically synthesized oligonucleotide
ccctgctccaggcccccgg

SEQ ID NO: 9608 - DNA, 19 bp, Artificial Sequence
  Description of Artificial Sequence: Chemically synthesized oligonucleotide
ccgggggcctggagcaggg

SEQ ID NO: 9609 - DNA, 19 bp, Artificial Sequence
  Description of Artificial Sequence: Chemically synthesized oligonucleotide
cctgctccaggcccccgga

SEQ ID NO: 9610 - DNA, 19 bp, Artificial Sequence
  Description of Artificial Sequence: Chemically synthesized oligonucleotide
tccgggggcctggagcagg

SEQ ID NO: 9611 - DNA, 19 bp, Artificial Sequence
  Description of Artificial Sequence: Chemically synthesized oligonucleotide
ctgctccaggcccccggag

SEQ ID NO: 9612 - DNA, 19 bp, Artificial Sequence
  Description of Artificial Sequence: Chemically synthesized oligonucleotide
ctccgggggcctggagcag

SEQ ID NO: 9613 - DNA, 19 bp, Artificial Sequence
  Description of Artificial Sequence: Chemically synthesized oligonucleotide
tgctccaggcccccggaga

SEQ ID NO: 9614 - DNA, 19 bp, Artificial Sequence
  Description of Artificial Sequence: Chemically synthesized oligonucleotide
tctccgggggcctggagca

SEQ ID NO: 9615 - DNA, 19 bp, Artificial Sequence
  Description of Artificial Sequence: Chemically synthesized oligonucleotide
gctccaggcccccggagag

SEQ ID NO: 9616 - DNA, 19 bp, Artificial Sequence
  Description of Artificial Sequence: Chemically synthesized oligonucleotide
ctctccgggggcctggagc

SEQ ID NO: 9617 - DNA, 19 bp, Artificial Sequence
  Description of Artificial Sequence: Chemically synthesized oligonucleotide
ctccaggcccccggagagg

SEQ ID NO: 9618 - DNA, 19 bp, Artificial Sequence
  Description of Artificial Sequence: Chemically synthesized oligonucleotide
cctctccgggggcctggag

SEQ ID NO: 9619 - DNA, 19 bp, Artificial Sequence
  Description of Artificial Sequence: Chemically synthesized oligonucleotide
tccaggcccccggagaggc

SEQ ID NO: 9620 - DNA, 19 bp, Artificial Sequence
  Description of Artificial Sequence: Chemically synthesized oligonucleotide
gcctctccgggggcctgga

SEQ ID NO: 9621 - DNA, 19 bp, Artificial Sequence
  Description of Artificial Sequence: Chemically synthesized oligonucleotide
ccaggcccccggagaggcc

SEQ ID NO: 9622 - DNA, 19 bp, Artificial Sequence
  Description of Artificial Sequence: Chemically synthesized oligonucleotide
ggcctctccgggggcctgg

SEQ ID NO: 9623 - DNA, 19 bp, Artificial Sequence
  Description of Artificial Sequence: Chemically synthesized oligonucleotide
caggcccccggagaggccg

SEQ ID NO: 9624 - DNA, 19 bp, Artificial Sequence
  Description of Artificial Sequence: Chemically synthesized oligonucleotide
cggcctctccgggggcctg

SEQ ID NO: 9625 - DNA, 19 bp, Artificial Sequence
  Description of Artificial Sequence: Chemically synthesized oligonucleotide
aggcccccggagaggccgt

SEQ ID NO: 9626 - DNA, 19 bp, Artificial Sequence
  Description of Artificial Sequence: Chemically synthesized oligonucleotide
acggcctctccgggggcct

SEQ ID NO: 9627 - DNA, 19 bp, Artificial Sequence
  Description of Artificial Sequence: Chemically synthesized oligonucleotide
ggcccccggagaggccgtg

SEQ ID NO: 9628 - DNA, 19 bp, Artificial Sequence
  Description of Artificial Sequence: Chemically synthesized oligonucleotide
cacggcctctccgggggcc

SEQ ID NO: 9629 - DNA, 19 bp, Artificial Sequence
  Description of Artificial Sequence: Chemically synthesized oligonucleotide
gcccccggagaggccgtgc

SEQ ID NO: 9630 - DNA, 19 bp, Artificial Sequence
  Description of Artificial Sequence: Chemically synthesized oligonucleotide
gcacggcctctccgggggc

SEQ ID NO: 9631 - DNA, 19 bp, Artificial Sequence
  Description of Artificial Sequence: Chemically synthesized oligonucleotide
cccccggagaggccgtgct

SEQ ID NO: 9632 - DNA, 19 bp, Artificial Sequence
  Description of Artificial Sequence: Chemically synthesized oligonucleotide
agcacggcctctccggggg

SEQ ID NO: 9633 - DNA, 19 bp, Artificial Sequence
  Description of Artificial Sequence: Chemically synthesized oligonucleotide
ccccggagaggccgtgctg

SEQ ID NO: 9634 - DNA, 19 bp, Artificial Sequence
  Description of Artificial Sequence: Chemically synthesized oligonucleotide
cagcacggcctctccgggg

SEQ ID NO: 9635 - DNA, 19 bp, Artificial Sequence
  Description of Artificial Sequence: Chemically synthesized oligonucleotide
cccggagaggccgtgctgg

SEQ ID NO: 9636 - DNA, 19 bp, Artificial Sequence
  Description of Artificial Sequence: Chemically synthesized oligonucleotide
ccagcacggcctctccggg

SEQ ID NO: 9637 - DNA, 19 bp, Artificial Sequence
  Description of Artificial Sequence: Chemically synthesized oligonucleotide
ccggagaggccgtgctggt

SEQ ID NO: 9638 - DNA, 19 bp, Artificial Sequence
  Description of Artificial Sequence: Chemically synthesized oligonucleotide
accagcacggcctctccgg

SEQ ID NO: 9639 - DNA, 19 bp, Artificial Sequence
  Description of Artificial Sequence: Chemically synthesized oligonucleotide
cggagaggccgtgctggtg

SEQ ID NO: 9640 - DNA, 19 bp, Artificial Sequence
  Description of Artificial Sequence: Chemically synthesized oligonucleotide
caccagcacggcctctccg

SEQ ID NO: 9641 - DNA, 19 bp, Artificial Sequence
  Description of Artificial Sequence: Chemically synthesized oligonucleotide
ggagaggccgtgctggtgc

SEQ ID NO: 9642 - DNA, 19 bp, Artificial Sequence
  Description of Artificial Sequence: Chemically synthesized oligonucleotide
gcaccagcacggcctctcc

SEQ ID NO: 9643 - DNA, 19 bp, Artificial Sequence
  Description of Artificial Sequence: Chemically synthesized oligonucleotide
gagaggccgtgctggtgcc

SEQ ID NO: 9644 - DNA, 19 bp, Artificial Sequence
  Description of Artificial Sequence: Chemically synthesized oligonucleotide
ggcaccagcacggcctctc

SEQ ID NO: 9645 - DNA, 19 bp, Artificial Sequence
  Description of Artificial Sequence: Chemically synthesized oligonucleotide
agaggccgtgctggtgcct

SEQ ID NO: 9646 - DNA, 19 bp, Artificial Sequence
  Description of Artificial Sequence: Chemically synthesized oligonucleotide
aggcaccagcacggcctct

SEQ ID NO: 9647 - DNA, 19 bp, Artificial Sequence
  Description of Artificial Sequence: Chemically synthesized oligonucleotide
gaggccgtgctggtgcctg

SEQ ID NO: 9648 - DNA, 19 bp, Artificial Sequence
  Description of Artificial Sequence: Chemically synthesized oligonucleotide
caggcaccagcacggcctc

SEQ ID NO: 9649 - DNA, 19 bp, Artificial Sequence
  Description of Artificial Sequence: Chemically synthesized oligonucleotide
aggccgtgctggtgcctgc

SEQ ID NO: 9650 - DNA, 19 bp, Artificial Sequence
  Description of Artificial Sequence: Chemically synthesized oligonucleotide
gcaggcaccagcacggcct

SEQ ID NO: 9651 - DNA, 19 bp, Artificial Sequence
  Description of Artificial Sequence: Chemically synthesized oligonucleotide
ggccgtgctggtgcctgca

SEQ ID NO: 9652 - DNA, 19 bp, Artificial Sequence
  Description of Artificial Sequence: Chemically synthesized oligonucleotide
tgcaggcaccagcacggcc

SEQ ID NO: 9653 - DNA, 19 bp, Artificial Sequence
  Description of Artificial Sequence: Chemically synthesized oligonucleotide
gccgtgctggtgcctgcag

SEQ ID NO: 9654 - DNA, 19 bp, Artificial Sequence
  Description of Artificial Sequence: Chemically synthesized oligonucleotide
ctgcaggcaccagcacggc

SEQ ID NO: 9655 - DNA, 19 bp, Artificial Sequence
  Description of Artificial Sequence: Chemically synthesized oligonucleotide
ccgtgctggtgcctgcagg

SEQ ID NO: 9656 - DNA, 19 bp, Artificial Sequence
  Description of Artificial Sequence: Chemically synthesized oligonucleotide
cctgcaggcaccagcacgg

SEQ ID NO: 9657 - DNA, 19 bp, Artificial Sequence
  Description of Artificial Sequence: Chemically synthesized oligonucleotide
cgtgctggtgcctgcaggg

SEQ ID NO: 9658 - DNA, 19 bp, Artificial Sequence
  Description of Artificial Sequence: Chemically synthesized oligonucleotide
ccctgcaggcaccagcacg

SEQ ID NO: 9659 - DNA, 19 bp, Artificial Sequence
  Description of Artificial Sequence: Chemically synthesized oligonucleotide
gtgctggtgcctgcagggg

SEQ ID NO: 9660 - DNA, 19 bp, Artificial Sequence
  Description of Artificial Sequence: Chemically synthesized oligonucleotide
cccctgcaggcaccagcac

SEQ ID NO: 9661 - DNA, 19 bp, Artificial Sequence
  Description of Artificial Sequence: Chemically synthesized oligonucleotide
tgctggtgcctgcaggggc

SEQ ID NO: 9662 - DNA, 19 bp, Artificial Sequence
  Description of Artificial Sequence: Chemically synthesized oligonucleotide
gcccctgcaggcaccagca

SEQ ID NO: 9663 - DNA, 19 bp, Artificial Sequence
  Description of Artificial Sequence: Chemically synthesized oligonucleotide
gctggtgcctgcaggggct

SEQ ID NO: 9664 - DNA, 19 bp, Artificial Sequence
  Description of Artificial Sequence: Chemically synthesized oligonucleotide
agcccctgcaggcaccagc

SEQ ID NO: 9665 - DNA, 19 bp, Artificial Sequence
  Description of Artificial Sequence: Chemically synthesized oligonucleotide
ctggtgcctgcaggggctc

SEQ ID NO: 9666 - DNA, 19 bp, Artificial Sequence
  Description of Artificial Sequence: Chemically synthesized oligonucleotide
gagcccctgcaggcaccag

SEQ ID NO: 9667 - DNA, 19 bp, Artificial Sequence
  Description of Artificial Sequence: Chemically synthesized oligonucleotide
tggtgcctgcaggggctcc

SEQ ID NO: 9668 - DNA, 19 bp, Artificial Sequence
  Description of Artificial Sequence: Chemically synthesized oligonucleotide
ggagcccctgcaggcacca

SEQ ID NO: 9669 - DNA, 19 bp, Artificial Sequence
  Description of Artificial Sequence: Chemically synthesized oligonucleotide
ggtgcctgcaggggctccc

SEQ ID NO: 9670 - DNA, 19 bp, Artificial Sequence
  Description of Artificial Sequence: Chemically synthesized oligonucleotide
gggagcccctgcaggcacc

SEQ ID NO: 9671 - DNA, 19 bp, Artificial Sequence
  Description of Artificial Sequence: Chemically synthesized oligonucleotide
gtgcctgcaggggctcccc

SEQ ID NO: 9672 - DNA, 19 bp, Artificial Sequence
  Description of Artificial Sequence: Chemically synthesized oligonucleotide
ggggagcccctgcaggcac

SEQ ID NO: 9673 - DNA, 19 bp, Artificial Sequence
  Description of Artificial Sequence: Chemically synthesized oligonucleotide
tgcctgcaggggctcccca

SEQ ID NO: 9674 - DNA, 19 bp, Artificial Sequence
  Description of Artificial Sequence: Chemically synthesized oligonucleotide
tggggagcccctgcaggca

SEQ ID NO: 9675 - DNA, 19 bp, Artificial Sequence
  Description of Artificial Sequence: Chemically synthesized oligonucleotide
gcctgcaggggctccccac

SEQ ID NO: 9676 - DNA, 19 bp, Artificial Sequence
  Description of Artificial Sequence: Chemically synthesized oligonucleotide
gtggggagcccctgcaggc

SEQ ID NO: 9677 - DNA, 19 bp, Artificial Sequence
  Description of Artificial Sequence: Chemically synthesized oligonucleotide
cctgcaggggctccccacc

SEQ ID NO: 9678 - DNA, 19 bp, Artificial Sequence
  Description of Artificial Sequence: Chemically synthesized oligonucleotide
ggtggggagcccctgcagg

SEQ ID NO: 9679 - DNA, 19 bp, Artificial Sequence
  Description of Artificial Sequence: Chemically synthesized oligonucleotide
ctgcaggggctccccacca

SEQ ID NO: 9680 - DNA, 19 bp, Artificial Sequence
  Description of Artificial Sequence: Chemically synthesized oligonucleotide
tggtggggagcccctgcag

SEQ ID NO: 9681 - DNA, 19 bp, Artificial Sequence
  Description of Artificial Sequence: Chemically synthesized oligonucleotide
tgcaggggctccccaccag

SEQ ID NO: 9682 - DNA, 19 bp, Artificial Sequence
  Description of Artificial Sequence: Chemically synthesized oligonucleotide
ctggtggggagcccctgca

SEQ ID NO: 9683 - DNA, 19 bp, Artificial Sequence
  Description of Artificial Sequence: Chemically synthesized oligonucleotide
gcaggggctccccaccagg

SEQ ID NO: 9684 - DNA, 19 bp, Artificial Sequence
  Description of Artificial Sequence: Chemically synthesized oligonucleotide
cctggtggggagcccctgc

SEQ ID NO: 9685 - DNA, 19 bp, Artificial Sequence
  Description of Artificial Sequence: Chemically synthesized oligonucleotide
caggggctccccaccaggt

SEQ ID NO: 9686 - DNA, 19 bp, Artificial Sequence
  Description of Artificial Sequence: Chemically synthesized oligonucleotide
acctggtggggagcccctg

SEQ ID NO: 9687 - DNA, 19 bp, Artificial Sequence
  Description of Artificial Sequence: Chemically synthesized oligonucleotide
aggggctccccaccaggtg

SEQ ID NO: 9688 - DNA, 19 bp, Artificial Sequence
  Description of Artificial Sequence: Chemically synthesized oligonucleotide
cacctggtggggagcccct

SEQ ID NO: 9689 - DNA, 19 bp, Artificial Sequence
  Description of Artificial Sequence: Chemically synthesized oligonucleotide
ggggctccccaccaggtgc

SEQ ID NO: 9690 - DNA, 19 bp, Artificial Sequence
  Description of Artificial Sequence: Chemically synthesized oligonucleotide
gcacctggtggggagcccc

SEQ ID NO: 9691 - DNA, 19 bp, Artificial Sequence
  Description of Artificial Sequence: Chemically synthesized oligonucleotide
gggctccccaccaggtgca

SEQ ID NO: 9692 - DNA, 19 bp, Artificial Sequence
  Description of Artificial Sequence: Chemically synthesized oligonucleotide
tgcacctggtggggagccc

SEQ ID NO: 9693 - DNA, 19 bp, Artificial Sequence
  Description of Artificial Sequence: Chemically synthesized oligonucleotide
ggctccccaccaggtgcag

SEQ ID NO: 9694 - DNA, 19 bp, Artificial Sequence
  Description of Artificial Sequence: Chemically synthesized oligonucleotide
ctgcacctggtggggagcc

SEQ ID NO: 9695 - DNA, 19 bp, Artificial Sequence
  Description of Artificial Sequence: Chemically synthesized oligonucleotide
gctccccaccaggtgcagg

SEQ ID NO: 9696 - DNA, 19 bp, Artificial Sequence
  Description of Artificial Sequence: Chemically synthesized oligonucleotide
cctgcacctggtggggagc

SEQ ID NO: 9697 - DNA, 19 bp, Artificial Sequence
  Description of Artificial Sequence: Chemically synthesized oligonucleotide
ctccccaccaggtgcaggg

SEQ ID NO: 9698 - DNA, 19 bp, Artificial Sequence
  Description of Artificial Sequence: Chemically synthesized oligonucleotide
ccctgcacctggtggggag

SEQ ID NO: 9699 - DNA, 19 bp, Artificial Sequence
  Description of Artificial Sequence: Chemically synthesized oligonucleotide
tccccaccaggtgcagggc

SEQ ID NO: 9700 - DNA, 19 bp, Artificial Sequence
  Description of Artificial Sequence: Chemically synthesized oligonucleotide
gccctgcacctggtgggga

SEQ ID NO: 9701 - DNA, 19 bp, Artificial Sequence
  Description of Artificial Sequence: Chemically synthesized oligonucleotide
ccccaccaggtgcagggcc

SEQ ID NO: 9702 - DNA, 19 bp, Artificial Sequence
  Description of Artificial Sequence: Chemically synthesized oligonucleotide
ggccctgcacctggtgggg

SEQ ID NO: 9703 - DNA, 19 bp, Artificial Sequence
  Description of Artificial Sequence: Chemically synthesized oligonucleotide
cccaccaggtgcagggcct

SEQ ID NO: 9704 - DNA, 19 bp, Artificial Sequence
  Description of Artificial Sequence: Chemically synthesized oligonucleotide
aggccctgcacctggtggg

SEQ ID NO: 9705 - DNA, 19 bp, Artificial Sequence
  Description of Artificial Sequence: Chemically synthesized oligonucleotide
ccaccaggtgcagggcctg

SEQ ID NO: 9706 - DNA, 19 bp, Artificial Sequence
  Description of Artificial Sequence: Chemically synthesized oligonucleotide
caggccctgcacctggtgg

SEQ ID NO: 9707 - DNA, 19 bp, Artificial Sequence
  Description of Artificial Sequence: Chemically synthesized oligonucleotide
caccaggtgcagggcctgg

SEQ ID NO: 9708 - DNA, 19 bp, Artificial Sequence
  Description of Artificial Sequence: Chemically synthesized oligonucleotide
ccaggccctgcacctggtg

SEQ ID NO: 9709 - DNA, 19 bp, Artificial Sequence
  Description of Artificial Sequence: Chemically synthesized oligonucleotide
accaggtgcagggcctggt

SEQ ID NO: 9710 - DNA, 19 bp, Artificial Sequence
  Description of Artificial Sequence: Chemically synthesized oligonucleotide
accaggccctgcacctggt

SEQ ID NO: 9711 - DNA, 19 bp, Artificial Sequence
  Description of Artificial Sequence: Chemically synthesized oligonucleotide
ccaggtgcagggcctggtg

SEQ ID NO: 9712 - DNA, 19 bp, Artificial Sequence
  Description of Artificial Sequence: Chemically synthesized oligonucleotide
caccaggccctgcacctgg

SEQ ID NO: 9713 - DNA, 19 bp, Artificial Sequence
  Description of Artificial Sequence: Chemically synthesized oligonucleotide
caggtgcagggcctggtga

SEQ ID NO: 9714 - DNA, 19 bp, Artificial Sequence
  Description of Artificial Sequence: Chemically synthesized oligonucleotide
tcaccaggccctgcacctg

SEQ ID NO: 9715 - DNA, 19 bp, Artificial Sequence
  Description of Artificial Sequence: Chemically synthesized oligonucleotide
aggtgcagggcctggtgag

SEQ ID NO: 9716 - DNA, 19 bp, Artificial Sequence
  Description of Artificial Sequence: Chemically synthesized oligonucleotide
ctcaccaggccctgcacct

SEQ ID NO: 9717 - DNA, 19 bp, Artificial Sequence
  Description of Artificial Sequence: Chemically synthesized oligonucleotide
ggtgcagggcctggtgagc

SEQ ID NO: 9718 - DNA, 19 bp, Artificial Sequence
  Description of Artificial Sequence: Chemically synthesized oligonucleotide
gctcaccaggccctgcacc

SEQ ID NO: 9719 - DNA, 19 bp, Artificial Sequence
  Description of Artificial Sequence: Chemically synthesized oligonucleotide
gtgcagggcctggtgagca

SEQ ID NO: 9720 - DNA, 19 bp, Artificial Sequence
  Description of Artificial Sequence: Chemically synthesized oligonucleotide
tgctcaccaggccctgcac

SEQ ID NO: 9721 - DNA, 19 bp, Artificial Sequence
  Description of Artificial Sequence: Chemically synthesized oligonucleotide
tgcagggcctggtgagcac

SEQ ID NO: 9722 - DNA, 19 bp, Artificial Sequence
  Description of Artificial Sequence: Chemically synthesized oligonucleotide
gtgctcaccaggccctgca

SEQ ID NO: 9723 - DNA, 19 bp, Artificial Sequence
  Description of Artificial Sequence: Chemically synthesized oligonucleotide
gcagggcctggtgagcaca

SEQ ID NO: 9724 - DNA, 19 bp, Artificial Sequence
  Description of Artificial Sequence: Chemically synthesized oligonucleotide
tgtgctcaccaggccctgc

SEQ ID NO: 9725 - DNA, 19 bp, Artificial Sequence
  Description of Artificial Sequence: Chemically synthesized oligonucleotide
cagggcctggtgagcacag

SEQ ID NO: 9726 - DNA, 19 bp, Artificial Sequence
  Description of Artificial Sequence: Chemically synthesized oligonucleotide
ctgtgctcaccaggccctg

SEQ ID NO: 9727 - DNA, 19 bp, Artificial Sequence
  Description of Artificial Sequence: Chemically synthesized oligonucleotide
agggcctggtgagcacagt

SEQ ID NO: 9728 - DNA, 19 bp, Artificial Sequence
  Description of Artificial Sequence: Chemically synthesized oligonucleotide
actgtgctcaccaggccct

SEQ ID NO: 9729 - DNA, 19 bp, Artificial Sequence
  Description of Artificial Sequence: Chemically synthesized oligonucleotide
gggcctggtgagcacagtc

SEQ ID NO: 9730 - DNA, 19 bp, Artificial Sequence
  Description of Artificial Sequence: Chemically synthesized oligonucleotide
gactgtgctcaccaggccc

SEQ ID NO: 9731 - DNA, 19 bp, Artificial Sequence
  Description of Artificial Sequence: Chemically synthesized oligonucleotide
ggcctggtgagcacagtca

SEQ ID NO: 9732 - DNA, 19 bp, Artificial Sequence
  Description of Artificial Sequence: Chemically synthesized oligonucleotide
tgactgtgctcaccaggcc

SEQ ID NO: 9733 - DNA, 19 bp, Artificial Sequence
  Description of Artificial Sequence: Chemically synthesized oligonucleotide
gcctggtgagcacagtcag

SEQ ID NO: 9734 - DNA, 19 bp, Artificial Sequence
  Description of Artificial Sequence: Chemically synthesized oligonucleotide
ctgactgtgctcaccaggc

SEQ ID NO: 9735 - DNA, 19 bp, Artificial Sequence
  Description of Artificial Sequence: Chemically synthesized oligonucleotide
cctggtgagcacagtcagc

SEQ ID NO: 9736 - DNA, 19 bp, Artificial Sequence
  Description of Artificial Sequence: Chemically synthesized oligonucleotide
gctgactgtgctcaccagg

SEQ ID NO: 9737 - DNA, 19 bp, Artificial Sequence
  Description of Artificial Sequence: Chemically synthesized oligonucleotide
ctggtgagcacagtcagcg

SEQ ID NO: 9738 - DNA, 19 bp, Artificial Sequence
  Description of Artificial Sequence: Chemically synthesized oligonucleotide
cgctgactgtgctcaccag

SEQ ID NO: 9739 - DNA, 19 bp, Artificial Sequence
  Description of Artificial Sequence: Chemically synthesized oligonucleotide
tggtgagcacagtcagcgt

SEQ ID NO: 9740 - DNA, 19 bp, Artificial Sequence
  Description of Artificial Sequence: Chemically synthesized oligonucleotide
acgctgactgtgctcacca

SEQ ID NO: 9741 - DNA, 19 bp, Artificial Sequence
  Description of Artificial Sequence: Chemically synthesized oligonucleotide
ggtgagcacagtcagcgtc

SEQ ID NO: 9742 - DNA, 19 bp, Artificial Sequence
  Description of Artificial Sequence: Chemically synthesized oligonucleotide
gacgctgactgtgctcacc

SEQ ID NO: 9743 - DNA, 19 bp, Artificial Sequence
  Description of Artificial Sequence: Chemically synthesized oligonucleotide
gtgagcacagtcagcgtca

SEQ ID NO: 9744 - DNA, 19 bp, Artificial Sequence
  Description of Artificial Sequence: Chemically synthesized oligonucleotide
tgacgctgactgtgctcac

SEQ ID NO: 9745 - DNA, 19 bp, Artificial Sequence
  Description of Artificial Sequence: Chemically synthesized oligonucleotide
tgagcacagtcagcgtcac

SEQ ID NO: 9746 - DNA, 19 bp, Artificial Sequence
  Description of Artificial Sequence: Chemically synthesized oligonucleotide
gtgacgctgactgtgctca

SEQ ID NO: 9747 - DNA, 19 bp, Artificial Sequence
  Description of Artificial Sequence: Chemically synthesized oligonucleotide
gagcacagtcagcgtcact

SEQ ID NO: 9748 - DNA, 19 bp, Artificial Sequence
  Description of Artificial Sequence: Chemically synthesized oligonucleotide
agtgacgctgactgtgctc

SEQ ID NO: 9749 - DNA, 19 bp, Artificial Sequence
  Description of Artificial Sequence: Chemically synthesized oligonucleotide
agcacagtcagcgtcactc

SEQ ID NO: 9750 - DNA, 19 bp, Artificial Sequence
  Description of Artificial Sequence: Chemically synthesized oligonucleotide
gagtgacgctgactgtgct

SEQ ID NO: 9751 - DNA, 19 bp, Artificial Sequence
  Description of Artificial Sequence: Chemically synthesized oligonucleotide
gcacagtcagcgtcactca

SEQ ID NO: 9752 - DNA, 19 bp, Artificial Sequence
  Description of Artificial Sequence: Chemically synthesized oligonucleotide
tgagtgacgctgactgtgc

SEQ ID NO: 9753 - DNA, 19 bp, Artificial Sequence
  Description of Artificial Sequence: Chemically synthesized oligonucleotide
cacagtcagcgtcactcag

SEQ ID NO: 9754 - DNA, 19 bp, Artificial Sequence
  Description of Artificial Sequence: Chemically synthesized oligonucleotide
ctgagtgacgctgactgtg

SEQ ID NO: 9755 - DNA, 19 bp, Artificial Sequence
  Description of Artificial Sequence: Chemically synthesized oligonucleotide
acagtcagcgtcactcagc

SEQ ID NO: 9756 - DNA, 19 bp, Artificial Sequence
  Description of Artificial Sequence: Chemically synthesized oligonucleotide
gctgagtgacgctgactgt

SEQ ID NO: 9757 - DNA, 19 bp, Artificial Sequence
  Description of Artificial Sequence: Chemically synthesized oligonucleotide
cagtcagcgtcactcagca

SEQ ID NO: 9758 - DNA, 19 bp, Artificial Sequence
  Description of Artificial Sequence: Chemically synthesized oligonucleotide
tgctgagtgacgctgactg

SEQ ID NO: 9759 - DNA, 19 bp, Artificial Sequence
  Description of Artificial Sequence: Chemically synthesized oligonucleotide
agtcagcgtcactcagcac

SEQ ID NO: 9760 - DNA, 19 bp, Artificial Sequence
  Description of Artificial Sequence: Chemically synthesized oligonucleotide
gtgctgagtgacgctgact

SEQ ID NO: 9761 - DNA, 19 bp, Artificial Sequence
  Description of Artificial Sequence: Chemically synthesized oligonucleotide
gtcagcgtcactcagcact

SEQ ID NO: 9762 - DNA, 19 bp, Artificial Sequence
  Description of Artificial Sequence: Chemically synthesized oligonucleotide
agtgctgagtgacgctgac

SEQ ID NO: 9763 - DNA, 19 bp, Artificial Sequence
  Description of Artificial Sequence: Chemically synthesized oligonucleotide
tcagcgtcactcagcactt

SEQ ID NO: 9764 - DNA, 19 bp, Artificial Sequence
  Description of Artificial Sequence: Chemically synthesized oligonucleotide
aagtgctgagtgacgctga

SEQ ID NO: 9765 - DNA, 19 bp, Artificial Sequence
  Description of Artificial Sequence: Chemically synthesized oligonucleotide
cagcgtcactcagcacttc

SEQ ID NO: 9766 - DNA, 19 bp, Artificial Sequence
  Description of Artificial Sequence: Chemically synthesized oligonucleotide
gaagtgctgagtgacgctg

SEQ ID NO: 9767 - DNA, 19 bp, Artificial Sequence
  Description of Artificial Sequence: Chemically synthesized oligonucleotide
agcgtcactcagcacttcc

SEQ ID NO: 9768 - DNA, 19 bp, Artificial Sequence
  Description of Artificial Sequence: Chemically synthesized oligonucleotide
ggaagtgctgagtgacgct

SEQ ID NO: 9769 - DNA, 19 bp, Artificial Sequence
  Description of Artificial Sequence: Chemically synthesized oligonucleotide
gcgtcactcagcacttcct

SEQ ID NO: 9770 - DNA, 19 bp, Artificial Sequence
  Description of Artificial Sequence: Chemically synthesized oligonucleotide
aggaagtgctgagtgacgc

SEQ ID NO: 9771 - DNA, 19 bp, Artificial Sequence
  Description of Artificial Sequence: Chemically synthesized oligonucleotide
cgtcactcagcacttcctc

SEQ ID NO: 9772 - DNA, 19 bp, Artificial Sequence
  Description of Artificial Sequence: Chemically synthesized oligonucleotide
gaggaagtgctgagtgacg

SEQ ID NO: 9773 - DNA, 19 bp, Artificial Sequence
  Description of Artificial Sequence: Chemically synthesized oligonucleotide
gtcactcagcacttcctct

SEQ ID NO: 9774 - DNA, 19 bp, Artificial Sequence
  Description of Artificial Sequence: Chemically synthesized oligonucleotide
agaggaagtgctgagtgac

SEQ ID NO: 9775 - DNA, 19 bp, Artificial Sequence
  Description of Artificial Sequence: Chemically synthesized oligonucleotide
tcactcagcacttcctctc

SEQ ID NO: 9776 - DNA, 19 bp, Artificial Sequence
  Description of Artificial Sequence: Chemically synthesized oligonucleotide
gagaggaagtgctgagtga

SEQ ID NO: 9777 - DNA, 19 bp, Artificial Sequence
  Description of Artificial Sequence: Chemically synthesized oligonucleotide
cactcagcacttcctctcc

SEQ ID NO: 9778 - DNA, 19 bp, Artificial Sequence
  Description of Artificial Sequence: Chemically synthesized oligonucleotide
ggagaggaagtgctgagtg

SEQ ID NO: 9779 - DNA, 19 bp, Artificial Sequence
  Description of Artificial Sequence: Chemically synthesized oligonucleotide
actcagcacttcctctccc

SEQ ID NO: 9780 - DNA, 19 bp, Artificial Sequence
  Description of Artificial Sequence: Chemically synthesized oligonucleotide
gggagaggaagtgctgagt

SEQ ID NO: 9781 - DNA, 19 bp, Artificial Sequence
  Description of Artificial Sequence: Chemically synthesized oligonucleotide
ctcagcacttcctctcccc

SEQ ID NO: 9782 - DNA, 19 bp, Artificial Sequence
  Description of Artificial Sequence: Chemically synthesized oligonucleotide
ggggagaggaagtgctgag

SEQ ID NO: 9783 - DNA, 19 bp, Artificial Sequence
  Description of Artificial Sequence: Chemically synthesized oligonucleotide
tcagcacttcctctcccct

SEQ ID NO: 9784 - DNA, 19 bp, Artificial Sequence
  Description of Artificial Sequence: Chemically synthesized oligonucleotide
aggggagaggaagtgctga

SEQ ID NO: 9785 - DNA, 19 bp, Artificial Sequence
  Description of Artificial Sequence: Chemically synthesized oligonucleotide
cagcacttcctctcccctg

SEQ ID NO: 9786 - DNA, 19 bp, Artificial Sequence
  Description of Artificial Sequence: Chemically synthesized oligonucleotide
caggggagaggaagtgctg

SEQ ID NO: 9787 - DNA, 19 bp, Artificial Sequence
  Description of Artificial Sequence: Chemically synthesized oligonucleotide
agcacttcctctcccctga

SEQ ID NO: 9788 - DNA, 19 bp, Artificial Sequence
  Description of Artificial Sequence: Chemically synthesized oligonucleotide
tcaggggagaggaagtgct

SEQ ID NO: 9789 - DNA, 19 bp, Artificial Sequence
  Description of Artificial Sequence: Chemically synthesized oligonucleotide
gcacttcctctcccctgag

SEQ ID NO: 9790 - DNA, 19 bp, Artificial Sequence
  Description of Artificial Sequence: Chemically synthesized oligonucleotide
ctcaggggagaggaagtgc

SEQ ID NO: 9791 - DNA, 19 bp, Artificial Sequence
  Description of Artificial Sequence: Chemically synthesized oligonucleotide
cacttcctctcccctgaga

SEQ ID NO: 9792 - DNA, 19 bp, Artificial Sequence
  Description of Artificial Sequence: Chemically synthesized oligonucleotide
tctcaggggagaggaagtg

SEQ ID NO: 9793 - DNA, 19 bp, Artificial Sequence
  Description of Artificial Sequence: Chemically synthesized oligonucleotide
acttcctctcccctgagac

SEQ ID NO: 9794 - DNA, 19 bp, Artificial Sequence
  Description of Artificial Sequence: Chemically synthesized oligonucleotide
gtctcaggggagaggaagt

SEQ ID NO: 9795 - DNA, 19 bp, Artificial Sequence
  Description of Artificial Sequence: Chemically synthesized oligonucleotide
cttcctctcccctgagacc

SEQ ID NO: 9796 - DNA, 19 bp, Artificial Sequence
  Description of Artificial Sequence: Chemically synthesized oligonucleotide
ggtctcaggggagaggaag

SEQ ID NO: 9797 - DNA, 19 bp, Artificial Sequence
  Description of Artificial Sequence: Chemically synthesized oligonucleotide
ttcctctcccctgagacct

SEQ ID NO: 9798 - DNA, 19 bp, Artificial Sequence
  Description of Artificial Sequence: Chemically synthesized oligonucleotide
aggtctcaggggagaggaa

SEQ ID NO: 9799 - DNA, 19 bp, Artificial Sequence
  Description of Artificial Sequence: Chemically synthesized oligonucleotide
tcctctcccctgagacctc

SEQ ID NO: 9800 - DNA, 19 bp, Artificial Sequence
  Description of Artificial Sequence: Chemically synthesized oligonucleotide
gaggtctcaggggagagga

SEQ ID NO: 9801 - DNA, 19 bp, Artificial Sequence
  Description of Artificial Sequence: Chemically synthesized oligonucleotide
cctctcccctgagacctct

SEQ ID NO: 9802 - DNA, 19 bp, Artificial Sequence
  Description of Artificial Sequence: Chemically synthesized oligonucleotide
agaggtctcaggggagagg

SEQ ID NO: 9803 - DNA, 19 bp, Artificial Sequence
  Description of Artificial Sequence: Chemically synthesized oligonucleotide
ctctcccctgagacctctg

SEQ ID NO: 9804 - DNA, 19 bp, Artificial Sequence
  Description of Artificial Sequence: Chemically synthesized oligonucleotide
cagaggtctcaggggagag

SEQ ID NO: 9805 - DNA, 19 bp, Artificial Sequence
  Description of Artificial Sequence: Chemically synthesized oligonucleotide
tctcccctgagacctctgc

SEQ ID NO: 9806 - DNA, 19 bp, Artificial Sequence
  Description of Artificial Sequence: Chemically synthesized oligonucleotide
gcagaggtctcaggggaga

SEQ ID NO: 9807 - DNA, 19 bp, Artificial Sequence
  Description of Artificial Sequence: Chemically synthesized oligonucleotide
ctcccctgagacctctgcc

SEQ ID NO: 9808 - DNA, 19 bp, Artificial Sequence
  Description of Artificial Sequence: Chemically synthesized oligonucleotide
ggcagaggtctcaggggag

SEQ ID NO: 9809 - DNA, 19 bp, Artificial Sequence
  Description of Artificial Sequence: Chemically synthesized oligonucleotide
tcccctgagacctctgccc

SEQ ID NO: 9810 - DNA, 19 bp, Artificial Sequence
  Description of Artificial Sequence: Chemically synthesized oligonucleotide
gggcagaggtctcagggga

SEQ ID NO: 9811 - DNA, 19 bp, Artificial Sequence
  Description of Artificial Sequence: Chemically synthesized oligonucleotide
cccctgagacctctgccct

SEQ ID NO: 9812 - DNA, 19 bp, Artificial Sequence
  Description of Artificial Sequence: Chemically synthesized oligonucleotide
agggcagaggtctcagggg

SEQ ID NO: 9813 - DNA, 19 bp, Artificial Sequence
  Description of Artificial Sequence: Chemically synthesized oligonucleotide
ccctgagacctctgccctc

SEQ ID NO: 9814 - DNA, 19 bp, Artificial Sequence
  Description of Artificial Sequence: Chemically synthesized oligonucleotide
gagggcagaggtctcaggg

SEQ ID NO: 9815 - DNA, 19 bp, Artificial Sequence
  Description of Artificial Sequence: Chemically synthesized oligonucleotide
cctgagacctctgccctct

SEQ ID NO: 9816 - DNA, 19 bp, Artificial Sequence
  Description of Artificial Sequence: Chemically synthesized oligonucleotide
agagggcagaggtctcagg

SEQ ID NO: 9817 - DNA, 19 bp, Artificial Sequence
  Description of Artificial Sequence: Chemically synthesized oligonucleotide
ctgagacctctgccctctc

SEQ ID NO: 9818 - DNA, 19 bp, Artificial Sequence
  Description of Artificial Sequence: Chemically synthesized oligonucleotide
gagagggcagaggtctcag

SEQ ID NO: 9819 - DNA, 19 bp, Artificial Sequence
  Description of Artificial Sequence: Chemically synthesized oligonucleotide
tgagacctctgccctctct

SEQ ID NO: 9820 - DNA, 19 bp, Artificial Sequence
  Description of Artificial Sequence: Chemically synthesized oligonucleotide
agagagggcagaggtctca

SEQ ID NO: 9821 - DNA, 19 bp, Artificial Sequence
  Description of Artificial Sequence: Chemically synthesized oligonucleotide
gagacctctgccctctctg

SEQ ID NO: 9822 - DNA, 19 bp, Artificial Sequence
  Description of Artificial Sequence: Chemically synthesized oligonucleotide
cagagagggcagaggtctc

SEQ ID NO: 9823 - DNA, 19 bp, Artificial Sequence
  Description of Artificial Sequence: Chemically synthesized oligonucleotide
agacctctgccctctctgc

SEQ ID NO: 9824 - DNA, 19 bp, Artificial Sequence
  Description of Artificial Sequence: Chemically synthesized oligonucleotide
gcagagagggcagaggtct

SEQ ID NO: 9825 - DNA, 19 bp, Artificial Sequence
  Description of Artificial Sequence: Chemically synthesized oligonucleotide
gacctctgccctctctgct

SEQ ID NO: 9826 - DNA, 19 bp, Artificial Sequence
  Description of Artificial Sequence: Chemically synthesized oligonucleotide
agcagagagggcagaggtc

SEQ ID NO: 9827 - DNA, 19 bp, Artificial Sequence
  Description of Artificial Sequence: Chemically synthesized oligonucleotide
acctctgccctctctgctc

SEQ ID NO: 9828 - DNA, 19 bp, Artificial Sequence
  Description of Artificial Sequence: Chemically synthesized oligonucleotide
gagcagagagggcagaggt

SEQ ID NO: 9829 - DNA, 19 bp, Artificial Sequence
  Description of Artificial Sequence: Chemically synthesized oligonucleotide
cctctgccctctctgctca

SEQ ID NO: 9830 - DNA, 19 bp, Artificial Sequence
  Description of Artificial Sequence: Chemically synthesized oligonucleotide
tgagcagagagggcagagg

SEQ ID NO: 9831 - DNA, 19 bp, Artificial Sequence
  Description of Artificial Sequence: Chemically synthesized oligonucleotide
ctctgccctctctgctcag

SEQ ID NO: 9832 - DNA, 19 bp, Artificial Sequence
  Description of Artificial Sequence: Chemically synthesized oligonucleotide
ctgagcagagagggcagag

SEQ ID NO: 9833 - DNA, 19 bp, Artificial Sequence
  Description of Artificial Sequence: Chemically synthesized oligonucleotide
tctgccctctctgctcagc

SEQ ID NO: 9834 - DNA, 19 bp, Artificial Sequence
  Description of Artificial Sequence: Chemically synthesized oligonucleotide
gctgagcagagagggcaga

SEQ ID NO: 9835 - DNA, 19 bp, Artificial Sequence
  Description of Artificial Sequence: Chemically synthesized oligonucleotide
ctgccctctctgctcagct

SEQ ID NO: 9836 - DNA, 19 bp, Artificial Sequence
  Description of Artificial Sequence: Chemically synthesized oligonucleotide
agctgagcagagagggcag

SEQ ID NO: 9837 - DNA, 19 bp, Artificial Sequence
  Description of Artificial Sequence: Chemically synthesized oligonucleotide
tgccctctctgctcagctc

SEQ ID NO: 9838 - DNA, 19 bp, Artificial Sequence
  Description of Artificial Sequence: Chemically synthesized oligonucleotide
gagctgagcagagagggca

SEQ ID NO: 9839 - DNA, 19 bp, Artificial Sequence
  Description of Artificial Sequence: Chemically synthesized oligonucleotide
gccctctctgctcagctct

SEQ ID NO: 9840 - DNA, 19 bp, Artificial Sequence
  Description of Artificial Sequence: Chemically synthesized oligonucleotide
agagctgagcagagagggc

SEQ ID NO: 9841 - DNA, 19 bp, Artificial Sequence
  Description of Artificial Sequence: Chemically synthesized oligonucleotide
ccctctctgctcagctctg

SEQ ID NO: 9842 - DNA, 19 bp, Artificial Sequence
  Description of Artificial Sequence: Chemically synthesized oligonucleotide
cagagctgagcagagaggg

SEQ ID NO: 9843 - DNA, 19 bp, Artificial Sequence
  Description of Artificial Sequence: Chemically synthesized oligonucleotide
cctctctgctcagctctgc

SEQ ID NO: 9844 - DNA, 19 bp, Artificial Sequence
  Description of Artificial Sequence: Chemically synthesized oligonucleotide
gcagagctgagcagagagg

SEQ ID NO: 9845 - DNA, 19 bp, Artificial Sequence
  Description of Artificial Sequence: Chemically synthesized oligonucleotide
ctctctgctcagctctgcc

SEQ ID NO: 9846 - DNA, 19 bp, Artificial Sequence
  Description of Artificial Sequence: Chemically synthesized oligonucleotide
ggcagagctgagcagagag

SEQ ID NO: 9847 - DNA, 19 bp, Artificial Sequence
  Description of Artificial Sequence: Chemically synthesized oligonucleotide
tctctgctcagctctgcca

SEQ ID NO: 9848 - DNA, 19 bp, Artificial Sequence
  Description of Artificial Sequence: Chemically synthesized oligonucleotide
tggcagagctgagcagaga

SEQ ID NO: 9849 - DNA, 19 bp, Artificial Sequence
  Description of Artificial Sequence: Chemically synthesized oligonucleotide
ctctgctcagctctgccac

SEQ ID NO: 9850 - DNA, 19 bp, Artificial Sequence
  Description of Artificial Sequence: Chemically synthesized oligonucleotide
gtggcagagctgagcagag

SEQ ID NO: 9851 - DNA, 19 bp, Artificial Sequence
  Description of Artificial Sequence: Chemically synthesized oligonucleotide
tctgctcagctctgccacc

SEQ ID NO: 9852 - DNA, 19 bp, Artificial Sequence
  Description of Artificial Sequence: Chemically synthesized oligonucleotide
ggtggcagagctgagcaga

SEQ ID NO: 9853 - DNA, 19 bp, Artificial Sequence
  Description of Artificial Sequence: Chemically synthesized oligonucleotide
ctgctcagctctgccacca

SEQ ID NO: 9854 - DNA, 19 bp, Artificial Sequence
  Description of Artificial Sequence: Chemically synthesized oligonucleotide
tggtggcagagctgagcag

SEQ ID NO: 9855 - DNA, 19 bp, Artificial Sequence
  Description of Artificial Sequence: Chemically synthesized oligonucleotide
tgctcagctctgccaccag

SEQ ID NO: 9856 - DNA, 19 bp, Artificial Sequence
  Description of Artificial Sequence: Chemically synthesized oligonucleotide
ctggtggcagagctgagca

SEQ ID NO: 9857 - DNA, 19 bp, Artificial Sequence
  Description of Artificial Sequence: Chemically synthesized oligonucleotide
gctcagctctgccaccagg

SEQ ID NO: 9858 - DNA, 19 bp, Artificial Sequence
  Description of Artificial Sequence: Chemically synthesized oligonucleotide
cctggtggcagagctgagc

SEQ ID NO: 9859 - DNA, 19 bp, Artificial Sequence
  Description of Artificial Sequence: Chemically synthesized oligonucleotide
ctcagctctgccaccaggg

SEQ ID NO: 9860 - DNA, 19 bp, Artificial Sequence
  Description of Artificial Sequence: Chemically synthesized oligonucleotide
ccctggtggcagagctgag

SEQ ID NO: 9861 - DNA, 19 bp, Artificial Sequence
  Description of Artificial Sequence: Chemically synthesized oligonucleotide
tcagctctgccaccaggga

SEQ ID NO: 9862 - DNA, 19 bp, Artificial Sequence
  Description of Artificial Sequence: Chemically synthesized oligonucleotide
tccctggtggcagagctga

SEQ ID NO: 9863 - DNA, 19 bp, Artificial Sequence
  Description of Artificial Sequence: Chemically synthesized oligonucleotide
cagctctgccaccagggac

SEQ ID NO: 9864 - DNA, 19 bp, Artificial Sequence
  Description of Artificial Sequence: Chemically synthesized oligonucleotide
gtccctggtggcagagctg

SEQ ID NO: 9865 - DNA, 19 bp, Artificial Sequence
  Description of Artificial Sequence: Chemically synthesized oligonucleotide
agctctgccaccagggacc

SEQ ID NO: 9866 - DNA, 19 bp, Artificial Sequence
  Description of Artificial Sequence: Chemically synthesized oligonucleotide
ggtccctggtggcagagct

SEQ ID NO: 9867 - DNA, 19 bp, Artificial Sequence
  Description of Artificial Sequence: Chemically synthesized oligonucleotide
gctctgccaccagggaccc

SEQ ID NO: 9868 - DNA, 19 bp, Artificial Sequence
  Description of Artificial Sequence: Chemically synthesized oligonucleotide
gggtccctggtggcagagc

SEQ ID NO: 9869 - DNA, 19 bp, Artificial Sequence
  Description of Artificial Sequence: Chemically synthesized oligonucleotide
ctctgccaccagggaccca

SEQ ID NO: 9870 - DNA, 19 bp, Artificial Sequence
  Description of Artificial Sequence: Chemically synthesized oligonucleotide
tgggtccctggtggcagag

SEQ ID NO: 9871 - DNA, 19 bp, Artificial Sequence
  Description of Artificial Sequence: Chemically synthesized oligonucleotide
tctgccaccagggacccag

SEQ ID NO: 9872 - DNA, 19 bp, Artificial Sequence
  Description of Artificial Sequence: Chemically synthesized oligonucleotide
ctgggtccctggtggcaga

SEQ ID NO: 9873 - DNA, 19 bp, Artificial Sequence
  Description of Artificial Sequence: Chemically synthesized oligonucleotide
ctgccaccagggacccagc

SEQ ID NO: 9874 - DNA, 19 bp, Artificial Sequence
  Description of Artificial Sequence: Chemically synthesized oligonucleotide
gctgggtccctggtggcag

SEQ ID NO: 9875 - DNA, 19 bp, Artificial Sequence
  Description of Artificial Sequence: Chemically synthesized oligonucleotide
tgccaccagggacccagcc

SEQ ID NO: 9876 - DNA, 19 bp, Artificial Sequence
  Description of Artificial Sequence: Chemically synthesized oligonucleotide
ggctgggtccctggtggca

SEQ ID NO: 9877 - DNA, 19 bp, Artificial Sequence
  Description of Artificial Sequence: Chemically synthesized oligonucleotide
gccaccagggacccagcct

SEQ ID NO: 9878 - DNA, 19 bp, Artificial Sequence
  Description of Artificial Sequence: Chemically synthesized oligonucleotide
aggctgggtccctggtggc

SEQ ID NO: 9879 - DNA, 19 bp, Artificial Sequence
  Description of Artificial Sequence: Chemically synthesized oligonucleotide
ccaccagggacccagcctt

SEQ ID NO: 9880 - DNA, 19 bp, Artificial Sequence
  Description of Artificial Sequence: Chemically synthesized oligonucleotide
aaggctgggtccctggtgg

SEQ ID NO: 9881 - DNA, 19 bp, Artificial Sequence
  Description of Artificial Sequence: Chemically synthesized oligonucleotide
caccagggacccagccttc

SEQ ID NO: 9882 - DNA, 19 bp, Artificial Sequence
  Description of Artificial Sequence: Chemically synthesized oligonucleotide
gaaggctgggtccctggtg

SEQ ID NO: 9883 - DNA, 19 bp, Artificial Sequence
  Description of Artificial Sequence: Chemically synthesized oligonucleotide
accagggacccagccttcc

SEQ ID NO: 9884 - DNA, 19 bp, Artificial Sequence
  Description of Artificial Sequence: Chemically synthesized oligonucleotide
ggaaggctgggtccctggt

SEQ ID NO: 9885 - DNA, 19 bp, Artificial Sequence
  Description of Artificial Sequence: Chemically synthesized oligonucleotide
ccagggacccagccttccc

SEQ ID NO: 9886 - DNA, 19 bp, Artificial Sequence
  Description of Artificial Sequence: Chemically synthesized oligonucleotide
gggaaggctgggtccctgg

SEQ ID NO: 9887 - DNA, 19 bp, Artificial Sequence
  Description of Artificial Sequence: Chemically synthesized oligonucleotide
cagggacccagccttcccc

SEQ ID NO: 9888 - DNA, 19 bp, Artificial Sequence
  Description of Artificial Sequence: Chemically synthesized oligonucleotide
ggggaaggctgggtccctg

SEQ ID NO: 9889 - DNA, 19 bp, Artificial Sequence
  Description of Artificial Sequence: Chemically synthesized oligonucleotide
agggacccagccttccccc

SEQ ID NO: 9890 - DNA, 19 bp, Artificial Sequence
  Description of Artificial Sequence: Chemically synthesized oligonucleotide
gggggaaggctgggtccct

SEQ ID NO: 9891 - DNA, 19 bp, Artificial Sequence
  Description of Artificial Sequence: Chemically synthesized oligonucleotide
gggacccagccttccccct

SEQ ID NO: 9892 - DNA, 19 bp, Artificial Sequence
  Description of Artificial Sequence: Chemically synthesized oligonucleotide
agggggaaggctgggtccc

SEQ ID NO: 9893 - DNA, 19 bp, Artificial Sequence
  Description of Artificial Sequence: Chemically synthesized oligonucleotide
ggacccagccttccccctg

SEQ ID NO: 9894 - DNA, 19 bp, Artificial Sequence
  Description of Artificial Sequence: Chemically synthesized oligonucleotide
cagggggaaggctgggtcc

SEQ ID NO: 9895 - DNA, 19 bp, Artificial Sequence
  Description of Artificial Sequence: Chemically synthesized oligonucleotide
gacccagccttccccctga

SEQ ID NO: 9896 - DNA, 19 bp, Artificial Sequence
  Description of Artificial Sequence: Chemically synthesized oligonucleotide
tcagggggaaggctgggtc

SEQ ID NO: 9897 - DNA, 19 bp, Artificial Sequence
  Description of Artificial Sequence: Chemically synthesized oligonucleotide
acccagccttccccctgac

SEQ ID NO: 9898 - DNA, 19 bp, Artificial Sequence
  Description of Artificial Sequence: Chemically synthesized oligonucleotide
gtcagggggaaggctgggt

SEQ ID NO: 9899 - DNA, 19 bp, Artificial Sequence
  Description of Artificial Sequence: Chemically synthesized oligonucleotide
cccagccttccccctgact

SEQ ID NO: 9900 - DNA, 19 bp, Artificial Sequence
  Description of Artificial Sequence: Chemically synthesized oligonucleotide
agtcagggggaaggctggg

SEQ ID NO: 9901 - DNA, 19 bp, Artificial Sequence
  Description of Artificial Sequence: Chemically synthesized oligonucleotide
ccagccttccccctgactg

SEQ ID NO: 9902 - DNA, 19 bp, Artificial Sequence
  Description of Artificial Sequence: Chemically synthesized oligonucleotide
cagtcagggggaaggctgg

SEQ ID NO: 9903 - DNA, 19 bp, Artificial Sequence
  Description of Artificial Sequence: Chemically synthesized oligonucleotide
cagccttccccctgactgc

SEQ ID NO: 9904 - DNA, 19 bp, Artificial Sequence
  Description of Artificial Sequence: Chemically synthesized oligonucleotide
gcagtcagggggaaggctg

SEQ ID NO: 9905 - DNA, 19 bp, Artificial Sequence
  Description of Artificial Sequence: Chemically synthesized oligonucleotide
agccttccccctgactgcc

SEQ ID NO: 9906 - DNA, 19 bp, Artificial Sequence
  Description of Artificial Sequence: Chemically synthesized oligonucleotide
ggcagtcagggggaaggct

SEQ ID NO: 9907 - DNA, 19 bp, Artificial Sequence
  Description of Artificial Sequence: Chemically synthesized oligonucleotide
gccttccccctgactgcca

SEQ ID NO: 9908 - DNA, 19 bp, Artificial Sequence
  Description of Artificial Sequence: Chemically synthesized oligonucleotide
tggcagtcagggggaaggc

SEQ ID NO: 9909 - DNA, 19 bp, Artificial Sequence
  Description of Artificial Sequence: Chemically synthesized oligonucleotide
ccttccccctgactgccac

SEQ ID NO: 9910 - DNA, 19 bp, Artificial Sequence
  Description of Artificial Sequence: Chemically synthesized oligonucleotide
gtggcagtcagggggaagg

SEQ ID NO: 9911 - DNA, 19 bp, Artificial Sequence
  Description of Artificial Sequence: Chemically synthesized oligonucleotide
cttccccctgactgccacc

SEQ ID NO: 9912 - DNA, 19 bp, Artificial Sequence
  Description of Artificial Sequence: Chemically synthesized oligonucleotide
ggtggcagtcagggggaag

SEQ ID NO: 9913 - DNA, 19 bp, Artificial Sequence
  Description of Artificial Sequence: Chemically synthesized oligonucleotide
ttccccctgactgccacct

SEQ ID NO: 9914 - DNA, 19 bp, Artificial Sequence
  Description of Artificial Sequence: Chemically synthesized oligonucleotide
aggtggcagtcagggggaa

SEQ ID NO: 9915 - DNA, 19 bp, Artificial Sequence
  Description of Artificial Sequence: Chemically synthesized oligonucleotide
tccccctgactgccacctg

SEQ ID NO: 9916 - DNA, 19 bp, Artificial Sequence
  Description of Artificial Sequence: Chemically synthesized oligonucleotide
caggtggcagtcaggggga

SEQ ID NO: 9917 - DNA, 19 bp, Artificial Sequence
  Description of Artificial Sequence: Chemically synthesized oligonucleotide
ccccctgactgccacctgc

SEQ ID NO: 9918 - DNA, 19 bp, Artificial Sequence
  Description of Artificial Sequence: Chemically synthesized oligonucleotide
gcaggtggcagtcaggggg

SEQ ID NO: 9919 - DNA, 19 bp, Artificial Sequence
  Description of Artificial Sequence: Chemically synthesized oligonucleotide
cccctgactgccacctgct

SEQ ID NO: 9920 - DNA, 19 bp, Artificial Sequence
  Description of Artificial Sequence: Chemically synthesized oligonucleotide
agcaggtggcagtcagggg

SEQ ID NO: 9921 - DNA, 19 bp, Artificial Sequence
  Description of Artificial Sequence: Chemically synthesized oligonucleotide
ccctgactgccacctgctt

SEQ ID NO: 9922 - DNA, 19 bp, Artificial Sequence
  Description of Artificial Sequence: Chemically synthesized oligonucleotide
aagcaggtggcagtcaggg

SEQ ID NO: 9923 - DNA, 19 bp, Artificial Sequence
  Description of Artificial Sequence: Chemically synthesized oligonucleotide
cctgactgccacctgcttt

SEQ ID NO: 9924 - DNA, 19 bp, Artificial Sequence
  Description of Artificial Sequence: Chemically synthesized oligonucleotide
aaagcaggtggcagtcagg

SEQ ID NO: 9925 - DNA, 19 bp, Artificial Sequence
  Description of Artificial Sequence: Chemically synthesized oligonucleotide
ctgactgccacctgcttta

SEQ ID NO: 9926 - DNA, 19 bp, Artificial Sequence
  Description of Artificial Sequence: Chemically synthesized oligonucleotide
taaagcaggtggcagtcag

SEQ ID NO: 9927 - DNA, 19 bp, Artificial Sequence
  Description of Artificial Sequence: Chemically synthesized oligonucleotide
tgactgccacctgctttat

SEQ ID NO: 9928 - DNA, 19 bp, Artificial Sequence
  Description of Artificial Sequence: Chemically synthesized oligonucleotide
ataaagcaggtggcagtca

SEQ ID NO: 9929 - DNA, 19 bp, Artificial Sequence
  Description of Artificial Sequence: Chemically synthesized oligonucleotide
gactgccacctgctttatg

SEQ ID NO: 9930 - DNA, 19 bp, Artificial Sequence
  Description of Artificial Sequence: Chemically synthesized oligonucleotide
cataaagcaggtggcagtc

SEQ ID NO: 9931 - DNA, 19 bp, Artificial Sequence
  Description of Artificial Sequence: Chemically synthesized oligonucleotide
actgccacctgctttatgc

SEQ ID NO: 9932 - DNA, 19 bp, Artificial Sequence
  Description of Artificial Sequence: Chemically synthesized oligonucleotide
gcataaagcaggtggcagt

SEQ ID NO: 9933 - DNA, 19 bp, Artificial Sequence
  Description of Artificial Sequence: Chemically synthesized oligonucleotide
ctgccacctgctttatgcc

SEQ ID NO: 9934 - DNA, 19 bp, Artificial Sequence
  Description of Artificial Sequence: Chemically synthesized oligonucleotide
ggcataaagcaggtggcag

SEQ ID NO: 9935 - DNA, 19 bp, Artificial Sequence
  Description of Artificial Sequence: Chemically synthesized oligonucleotide
tgccacctgctttatgccc

SEQ ID NO: 9936 - DNA, 19 bp, Artificial Sequence
  Description of Artificial Sequence: Chemically synthesized oligonucleotide
gggcataaagcaggtggca

SEQ ID NO: 9937 - DNA, 19 bp, Artificial Sequence
  Description of Artificial Sequence: Chemically synthesized oligonucleotide
gccacctgctttatgccca

SEQ ID NO: 9938 - DNA, 19 bp, Artificial Sequence
  Description of Artificial Sequence: Chemically synthesized oligonucleotide
tgggcataaagcaggtggc

SEQ ID NO: 9939 - DNA, 19 bp, Artificial Sequence
  Description of Artificial Sequence: Chemically synthesized oligonucleotide
ccacctgctttatgcccag

SEQ ID NO: 9940 - DNA, 19 bp, Artificial Sequence
  Description of Artificial Sequence: Chemically synthesized oligonucleotide
ctgggcataaagcaggtgg

SEQ ID NO: 9941 - DNA, 19 bp, Artificial Sequence
  Description of Artificial Sequence: Chemically synthesized oligonucleotide
cacctgctttatgcccaga

SEQ ID NO: 9942 - DNA, 19 bp, Artificial Sequence
  Description of Artificial Sequence: Chemically synthesized oligonucleotide
tctgggcataaagcaggtg

SEQ ID NO: 9943 - DNA, 19 bp, Artificial Sequence
  Description of Artificial Sequence: Chemically synthesized oligonucleotide
acctgctttatgcccagat

SEQ ID NO: 9944 - DNA, 19 bp, Artificial Sequence
  Description of Artificial Sequence: Chemically synthesized oligonucleotide
atctgggcataaagcaggt

SEQ ID NO: 9945 - DNA, 19 bp, Artificial Sequence
  Description of Artificial Sequence: Chemically synthesized oligonucleotide
cctgctttatgcccagatg

SEQ ID NO: 9946 - DNA, 19 bp, Artificial Sequence
  Description of Artificial Sequence: Chemically synthesized oligonucleotide
catctgggcataaagcagg

SEQ ID NO: 9947 - DNA, 19 bp, Artificial Sequence
  Description of Artificial Sequence: Chemically synthesized oligonucleotide
ctgctttatgcccagatgg

SEQ ID NO: 9948 - DNA, 19 bp, Artificial Sequence
  Description of Artificial Sequence: Chemically synthesized oligonucleotide
ccatctgggcataaagcag

SEQ ID NO: 9949 - DNA, 19 bp, Artificial Sequence
  Description of Artificial Sequence: Chemically synthesized oligonucleotide
tgctttatgcccagatgga

SEQ ID NO: 9950 - DNA, 19 bp, Artificial Sequence
  Description of Artificial Sequence: Chemically synthesized oligonucleotide
tccatctgggcataaagca

SEQ ID NO: 9951 - DNA, 19 bp, Artificial Sequence
  Description of Artificial Sequence: Chemically synthesized oligonucleotide
gctttatgcccagatggac

SEQ ID NO: 9952 - DNA, 19 bp, Artificial Sequence
  Description of Artificial Sequence: Chemically synthesized oligonucleotide
gtccatctgggcataaagc

SEQ ID NO: 9953 - DNA, 19 bp, Artificial Sequence
  Description of Artificial Sequence: Chemically synthesized oligonucleotide
ctttatgcccagatggact

SEQ ID NO: 9954 - DNA, 19 bp, Artificial Sequence
  Description of Artificial Sequence: Chemically synthesized oligonucleotide
agtccatctgggcataaag

SEQ ID NO: 9955 - DNA, 19 bp, Artificial Sequence
  Description of Artificial Sequence: Chemically synthesized oligonucleotide
tttatgcccagatggactg

SEQ ID NO: 9956 - DNA, 19 bp, Artificial Sequence
  Description of Artificial Sequence: Chemically synthesized oligonucleotide
cagtccatctgggcataaa

SEQ ID NO: 9957 - DNA, 19 bp, Artificial Sequence
  Description of Artificial Sequence: Chemically synthesized oligonucleotide
ttatgcccagatggactgg

SEQ ID NO: 9958 - DNA, 19 bp, Artificial Sequence
  Description of Artificial Sequence: Chemically synthesized oligonucleotide
ccagtccatctgggcataa

SEQ ID NO: 9959 - DNA, 19 bp, Artificial Sequence
  Description of Artificial Sequence: Chemically synthesized oligonucleotide
tatgcccagatggactggg

SEQ ID NO: 9960 - DNA, 19 bp, Artificial Sequence
  Description of Artificial Sequence: Chemically synthesized oligonucleotide
cccagtccatctgggcata

SEQ ID NO: 9961 - DNA, 19 bp, Artificial Sequence
  Description of Artificial Sequence: Chemically synthesized oligonucleotide
atgcccagatggactgggc

SEQ ID NO: 9962 - DNA, 19 bp, Artificial Sequence
  Description of Artificial Sequence: Chemically synthesized oligonucleotide
gcccagtccatctgggcat

SEQ ID NO: 9963 - DNA, 19 bp, Artificial Sequence
  Description of Artificial Sequence: Chemically synthesized oligonucleotide
tgcccagatggactgggct

SEQ ID NO: 9964 - DNA, 19 bp, Artificial Sequence
  Description of Artificial Sequence: Chemically synthesized oligonucleotide
agcccagtccatctgggca

SEQ ID NO: 9965 - DNA, 19 bp, Artificial Sequence
  Description of Artificial Sequence: Chemically synthesized oligonucleotide
gcccagatggactgggctg

SEQ ID NO: 9966 - DNA, 19 bp, Artificial Sequence
  Description of Artificial Sequence: Chemically synthesized oligonucleotide
cagcccagtccatctgggc

SEQ ID NO: 9967 - DNA, 19 bp, Artificial Sequence
  Description of Artificial Sequence: Chemically synthesized oligonucleotide
cccagatggactgggctgt

SEQ ID NO: 9968 - DNA, 19 bp, Artificial Sequence
  Description of Artificial Sequence: Chemically synthesized oligonucleotide
acagcccagtccatctggg

SEQ ID NO: 9969 - DNA, 19 bp, Artificial Sequence
  Description of Artificial Sequence: Chemically synthesized oligonucleotide
ccagatggactgggctgtg

SEQ ID NO: 9970 - DNA, 19 bp, Artificial Sequence
  Description of Artificial Sequence: Chemically synthesized oligonucleotide
cacagcccagtccatctgg

SEQ ID NO: 9971 - DNA, 19 bp, Artificial Sequence
  Description of Artificial Sequence: Chemically synthesized oligonucleotide
cagatggactgggctgtgt

SEQ ID NO: 9972 - DNA, 19 bp, Artificial Sequence
  Description of Artificial Sequence: Chemically synthesized oligonucleotide
acacagcccagtccatctg

SEQ ID NO: 9973 - DNA, 19 bp, Artificial Sequence
  Description of Artificial Sequence: Chemically synthesized oligonucleotide
agatggactgggctgtgtt

SEQ ID NO: 9974 - DNA, 19 bp, Artificial Sequence
  Description of Artificial Sequence: Chemically synthesized oligonucleotide
aacacagcccagtccatct

SEQ ID NO: 9975 - DNA, 19 bp, Artificial Sequence
  Description of Artificial Sequence: Chemically synthesized oligonucleotide
gatggactgggctgtgttc

SEQ ID NO: 9976 - DNA, 19 bp, Artificial Sequence
  Description of Artificial Sequence: Chemically synthesized oligonucleotide
gaacacagcccagtccatc

SEQ ID NO: 9977 - DNA, 19 bp, Artificial Sequence
  Description of Artificial Sequence: Chemically synthesized oligonucleotide
atggactgggctgtgttcc

SEQ ID NO: 9978 - DNA, 19 bp, Artificial Sequence
  Description of Artificial Sequence: Chemically synthesized oligonucleotide
ggaacacagcccagtccat

SEQ ID NO: 9979 - DNA, 19 bp, Artificial Sequence
  Description of Artificial Sequence: Chemically synthesized oligonucleotide
tggactgggctgtgttcca

SEQ ID NO: 9980 - DNA, 19 bp, Artificial Sequence
  Description of Artificial Sequence: Chemically synthesized oligonucleotide
tggaacacagcccagtcca

SEQ ID NO: 9981 - DNA, 19 bp, Artificial Sequence
  Description of Artificial Sequence: Chemically synthesized oligonucleotide
ggactgggctgtgttccaa

SEQ ID NO: 9982 - DNA, 19 bp, Artificial Sequence
  Description of Artificial Sequence: Chemically synthesized oligonucleotide
ttggaacacagcccagtcc

SEQ ID NO: 9983 - DNA, 19 bp, Artificial Sequence
  Description of Artificial Sequence: Chemically synthesized oligonucleotide
gactgggctgtgttccaag

SEQ ID NO: 9984 - DNA, 19 bp, Artificial Sequence
  Description of Artificial Sequence: Chemically synthesized oligonucleotide
cttggaacacagcccagtc

SEQ ID NO: 9985 - DNA, 19 bp, Artificial Sequence
  Description of Artificial Sequence: Chemically synthesized oligonucleotide
actgggctgtgttccaagc

SEQ ID NO: 9986 - DNA, 19 bp, Artificial Sequence
  Description of Artificial Sequence: Chemically synthesized oligonucleotide
gcttggaacacagcccagt

SEQ ID NO: 9987 - DNA, 19 bp, Artificial Sequence
  Description of Artificial Sequence: Chemically synthesized oligonucleotide
ctgggctgtgttccaagca

SEQ ID NO: 9988 - DNA, 19 bp, Artificial Sequence
  Description of Artificial Sequence: Chemically synthesized oligonucleotide
tgcttggaacacagcccag

SEQ ID NO: 9989 - DNA, 19 bp, Artificial Sequence
  Description of Artificial Sequence: Chemically synthesized oligonucleotide
tgggctgtgttccaagcag

SEQ ID NO: 9990 - DNA, 19 bp, Artificial Sequence
  Description of Artificial Sequence: Chemically synthesized oligonucleotide
ctgcttggaacacagccca

SEQ ID NO: 9991 - DNA, 19 bp, Artificial Sequence
  Description of Artificial Sequence: Chemically synthesized oligonucleotide
gggctgtgttccaagcagt

SEQ ID NO: 9992 - DNA, 19 bp, Artificial Sequence
  Description of Artificial Sequence: Chemically synthesized oligonucleotide
actgcttggaacacagccc

SEQ ID NO: 9993 - DNA, 19 bp, Artificial Sequence
  Description of Artificial Sequence: Chemically synthesized oligonucleotide
ggctgtgttccaagcagtg

SEQ ID NO: 9994 - DNA, 19 bp, Artificial Sequence
  Description of Artificial Sequence: Chemically synthesized oligonucleotide
cactgcttggaacacagcc

SEQ ID NO: 9995 - DNA, 19 bp, Artificial Sequence
  Description of Artificial Sequence: Chemically synthesized oligonucleotide
gctgtgttccaagcagtga

SEQ ID NO: 9996 - DNA, 19 bp, Artificial Sequence
  Description of Artificial Sequence: Chemically synthesized oligonucleotide
tcactgcttggaacacagc

SEQ ID NO: 9997 - DNA, 19 bp, Artificial Sequence
  Description of Artificial Sequence: Chemically synthesized oligonucleotide
ctgtgttccaagcagtgaa

SEQ ID NO: 9998 - DNA, 19 bp, Artificial Sequence
  Description of Artificial Sequence: Chemically synthesized oligonucleotide
ttcactgcttggaacacag

SEQ ID NO: 9999 - DNA, 19 bp, Artificial Sequence
  Description of Artificial Sequence: Chemically synthesized oligonucleotide
tgtgttccaagcagtgaag

SEQ ID NO: 10000 - DNA, 19 bp, Artificial Sequence
  Description of Artificial Sequence: Chemically synthesized oligonucleotide
cttcactgcttggaacaca

SEQ ID NO: 10001 - DNA, 19 bp, Artificial Sequence
  Description of Artificial Sequence: Chemically synthesized oligonucleotide
gtgttccaagcagtgaagg

SEQ ID NO: 10002 - DNA, 19 bp, Artificial Sequence
  Description of Artificial Sequence: Chemically synthesized oligonucleotide
ccttcactgcttggaacac

SEQ ID NO: 10003 - DNA, 19 bp, Artificial Sequence
  Description of Artificial Sequence: Chemically synthesized oligonucleotide
tgttccaagcagtgaaggt

SEQ ID NO: 10004 - DNA, 19 bp, Artificial Sequence
  Description of Artificial Sequence: Chemically synthesized oligonucleotide
accttcactgcttggaaca

SEQ ID NO: 10005 - DNA, 19 bp, Artificial Sequence
  Description of Artificial Sequence: Chemically synthesized oligonucleotide
gttccaagcagtgaaggtg

SEQ ID NO: 10006 - DNA, 19 bp, Artificial Sequence
  Description of Artificial Sequence: Chemically synthesized oligonucleotide
caccttcactgcttggaac

SEQ ID NO: 10007 - DNA, 19 bp, Artificial Sequence
  Description of Artificial Sequence: Chemically synthesized oligonucleotide
ttccaagcagtgaaggtgg

SEQ ID NO: 10008 - DNA, 19 bp, Artificial Sequence
  Description of Artificial Sequence: Chemically synthesized oligonucleotide
ccaccttcactgcttggaa

SEQ ID NO: 10009 - DNA, 19 bp, Artificial Sequence
  Description of Artificial Sequence: Chemically synthesized oligonucleotide
tccaagcagtgaaggtggc

SEQ ID NO: 10010 - DNA, 19 bp, Artificial Sequence
  Description of Artificial Sequence: Chemically synthesized oligonucleotide
gccaccttcactgcttgga

SEQ ID NO: 10011 - DNA, 19 bp, Artificial Sequence
  Description of Artificial Sequence: Chemically synthesized oligonucleotide
ccaagcagtgaaggtggcc

SEQ ID NO: 10012 - DNA, 19 bp, Artificial Sequence
  Description of Artificial Sequence: Chemically synthesized oligonucleotide
ggccaccttcactgcttgg

SEQ ID NO: 10013 - DNA, 19 bp, Artificial Sequence
  Description of Artificial Sequence: Chemically synthesized oligonucleotide
caagcagtgaaggtggccg

SEQ ID NO: 10014 - DNA, 19 bp, Artificial Sequence
  Description of Artificial Sequence: Chemically synthesized oligonucleotide
cggccaccttcactgcttg

SEQ ID NO: 10015 - DNA, 19 bp, Artificial Sequence
  Description of Artificial Sequence: Chemically synthesized oligonucleotide
aagcagtgaaggtggccgt

SEQ ID NO: 10016 - DNA, 19 bp, Artificial Sequence
  Description of Artificial Sequence: Chemically synthesized oligonucleotide
acggccaccttcactgctt

SEQ ID NO: 10017 - DNA, 19 bp, Artificial Sequence
  Description of Artificial Sequence: Chemically synthesized oligonucleotide
agcagtgaaggtggccgtg

SEQ ID NO: 10018 - DNA, 19 bp, Artificial Sequence
  Description of Artificial Sequence: Chemically synthesized oligonucleotide
cacggccaccttcactgct

SEQ ID NO: 10019 - DNA, 19 bp, Artificial Sequence
  Description of Artificial Sequence: Chemically synthesized oligonucleotide
gcagtgaaggtggccgtgg

SEQ ID NO: 10020 - DNA, 19 bp, Artificial Sequence
  Description of Artificial Sequence: Chemically synthesized oligonucleotide
ccacggccaccttcactgc

SEQ ID NO: 10021 - DNA, 19 bp, Artificial Sequence
  Description of Artificial Sequence: Chemically synthesized oligonucleotide
cagtgaaggtggccgtggg

SEQ ID NO: 10022 - DNA, 19 bp, Artificial Sequence
  Description of Artificial Sequence: Chemically synthesized oligonucleotide
cccacggccaccttcactg

SEQ ID NO: 10023 - DNA, 19 bp, Artificial Sequence
  Description of Artificial Sequence: Chemically synthesized oligonucleotide
agtgaaggtggccgtgggg

SEQ ID NO: 10024 - DNA, 19 bp, Artificial Sequence
  Description of Artificial Sequence: Chemically synthesized oligonucleotide
ccccacggccaccttcact

SEQ ID NO: 10025 - DNA, 19 bp, Artificial Sequence
  Description of Artificial Sequence: Chemically synthesized oligonucleotide
gtgaaggtggccgtgggga

SEQ ID NO: 10026 - DNA, 19 bp, Artificial Sequence
  Description of Artificial Sequence: Chemically synthesized oligonucleotide
tccccacggccaccttcac

SEQ ID NO: 10027 - DNA, 19 bp, Artificial Sequence
  Description of Artificial Sequence: Chemically synthesized oligonucleotide
tgaaggtggccgtggggac

SEQ ID NO: 10028 - DNA, 19 bp, Artificial Sequence
  Description of Artificial Sequence: Chemically synthesized oligonucleotide
gtccccacggccaccttca

SEQ ID NO: 10029 - DNA, 19 bp, Artificial Sequence
  Description of Artificial Sequence: Chemically synthesized oligonucleotide
gaaggtggccgtggggaca

SEQ ID NO: 10030 - DNA, 19 bp, Artificial Sequence
  Description of Artificial Sequence: Chemically synthesized oligonucleotide
tgtccccacggccaccttc

SEQ ID NO: 10031 - DNA, 19 bp, Artificial Sequence
  Description of Artificial Sequence: Chemically synthesized oligonucleotide
aaggtggccgtggggacat

SEQ ID NO: 10032 - DNA, 19 bp, Artificial Sequence
  Description of Artificial Sequence: Chemically synthesized oligonucleotide
atgtccccacggccacctt

SEQ ID NO: 10033 - DNA, 19 bp, Artificial Sequence
  Description of Artificial Sequence: Chemically synthesized oligonucleotide
aggtggccgtggggacatt

SEQ ID NO: 10034 - DNA, 19 bp, Artificial Sequence
  Description of Artificial Sequence: Chemically synthesized oligonucleotide
aatgtccccacggccacct

SEQ ID NO: 10035 - DNA, 19 bp, Artificial Sequence
  Description of Artificial Sequence: Chemically synthesized oligonucleotide
ggtggccgtggggacatta

SEQ ID NO: 10036 - DNA, 19 bp, Artificial Sequence
  Description of Artificial Sequence: Chemically synthesized oligonucleotide
taatgtccccacggccacc

SEQ ID NO: 10037 - DNA, 19 bp, Artificial Sequence
  Description of Artificial Sequence: Chemically synthesized oligonucleotide
gtggccgtggggacattac

SEQ ID NO: 10038 - DNA, 19 bp, Artificial Sequence
  Description of Artificial Sequence: Chemically synthesized oligonucleotide
gtaatgtccccacggccac

SEQ ID NO: 10039 - DNA, 19 bp, Artificial Sequence
  Description of Artificial Sequence: Chemically synthesized oligonucleotide
tggccgtggggacattaca

SEQ ID NO: 10040 - DNA, 19 bp, Artificial Sequence
  Description of Artificial Sequence: Chemically synthesized oligonucleotide
tgtaatgtccccacggcca

SEQ ID NO: 10041 - DNA, 19 bp, Artificial Sequence
  Description of Artificial Sequence: Chemically synthesized oligonucleotide
ggccgtggggacattacag

SEQ ID NO: 10042 - DNA, 19 bp, Artificial Sequence
  Description of Artificial Sequence: Chemically synthesized oligonucleotide
ctgtaatgtccccacggcc

SEQ ID NO: 10043 - DNA, 19 bp, Artificial Sequence
  Description of Artificial Sequence: Chemically synthesized oligonucleotide
gccgtggggacattacagg

SEQ ID NO: 10044 - DNA, 19 bp, Artificial Sequence
  Description of Artificial Sequence: Chemically synthesized oligonucleotide
cctgtaatgtccccacggc

SEQ ID NO: 10045 - DNA, 19 bp, Artificial Sequence
  Description of Artificial Sequence: Chemically synthesized oligonucleotide
ccgtggggacattacagga

SEQ ID NO: 10046 - DNA, 19 bp, Artificial Sequence
  Description of Artificial Sequence: Chemically synthesized oligonucleotide
tcctgtaatgtccccacgg

SEQ ID NO: 10047 - DNA, 19 bp, Artificial Sequence
  Description of Artificial Sequence: Chemically synthesized oligonucleotide
cgtggggacattacaggag

SEQ ID NO: 10048 - DNA, 19 bp, Artificial Sequence
  Description of Artificial Sequence: Chemically synthesized oligonucleotide
ctcctgtaatgtccccacg

SEQ ID NO: 10049 - DNA, 19 bp, Artificial Sequence
  Description of Artificial Sequence: Chemically synthesized oligonucleotide
gtggggacattacaggagg

SEQ ID NO: 10050 - DNA, 19 bp, Artificial Sequence
  Description of Artificial Sequence: Chemically synthesized oligonucleotide
cctcctgtaatgtccccac

SEQ ID NO: 10051 - DNA, 19 bp, Artificial Sequence
  Description of Artificial Sequence: Chemically synthesized oligonucleotide
tggggacattacaggaggc

SEQ ID NO: 10052 - DNA, 19 bp, Artificial Sequence
  Description of Artificial Sequence: Chemically synthesized oligonucleotide
gcctcctgtaatgtcccca

SEQ ID NO: 10053 - DNA, 19 bp, Artificial Sequence
  Description of Artificial Sequence: Chemically synthesized oligonucleotide
ggggacattacaggaggcc

SEQ ID NO: 10054 - DNA, 19 bp, Artificial Sequence
  Description of Artificial Sequence: Chemically synthesized oligonucleotide
ggcctcctgtaatgtcccc

SEQ ID NO: 10055 - DNA, 19 bp, Artificial Sequence
  Description of Artificial Sequence: Chemically synthesized oligonucleotide
gggacattacaggaggcca

SEQ ID NO: 10056 - DNA, 19 bp, Artificial Sequence
  Description of Artificial Sequence: Chemically synthesized oligonucleotide
tggcctcctgtaatgtccc

SEQ ID NO: 10057 - DNA, 19 bp, Artificial Sequence
  Description of Artificial Sequence: Chemically synthesized oligonucleotide
ggacattacaggaggccaa

SEQ ID NO: 10058 - DNA, 19 bp, Artificial Sequence
  Description of Artificial Sequence: Chemically synthesized oligonucleotide
ttggcctcctgtaatgtcc

SEQ ID NO: 10059 - DNA, 19 bp, Artificial Sequence
  Description of Artificial Sequence: Chemically synthesized oligonucleotide
gacattacaggaggccaaa

SEQ ID NO: 10060 - DNA, 19 bp, Artificial Sequence
  Description of Artificial Sequence: Chemically synthesized oligonucleotide
tttggcctcctgtaatgtc

SEQ ID NO: 10061 - DNA, 19 bp, Artificial Sequence
  Description of Artificial Sequence: Chemically synthesized oligonucleotide
acattacaggaggccaaat

SEQ ID NO: 10062 - DNA, 19 bp, Artificial Sequence
  Description of Artificial Sequence: Chemically synthesized oligonucleotide
atttggcctcctgtaatgt

SEQ ID NO: 10063 - DNA, 19 bp, Artificial Sequence
  Description of Artificial Sequence: Chemically synthesized oligonucleotide
cattacaggaggccaaata

SEQ ID NO: 10064 - DNA, 19 bp, Artificial Sequence
  Description of Artificial Sequence: Chemically synthesized oligonucleotide
tatttggcctcctgtaatg

SEQ ID NO: 10065 - DNA, 19 bp, Artificial Sequence
  Description of Artificial Sequence: Chemically synthesized oligonucleotide
attacaggaggccaaatag

SEQ ID NO: 10066 - DNA, 19 bp, Artificial Sequence
  Description of Artificial Sequence: Chemically synthesized oligonucleotide
ctatttggcctcctgtaat

SEQ ID NO: 10067 - DNA, 19 bp, Artificial Sequence
  Description of Artificial Sequence: Chemically synthesized oligonucleotide
ttacaggaggccaaataga

SEQ ID NO: 10068 - DNA, 19 bp, Artificial Sequence
  Description of Artificial Sequence: Chemically synthesized oligonucleotide
tctatttggcctcctgtaa

SEQ ID NO: 10069 - DNA, 19 bp, Artificial Sequence
  Description of Artificial Sequence: Chemically synthesized oligonucleotide
tacaggaggccaaatagag

SEQ ID NO: 10070 - DNA, 19 bp, Artificial Sequence
  Description of Artificial Sequence: Chemically synthesized oligonucleotide
ctctatttggcctcctgta

SEQ ID NO: 10071 - DNA, 19 bp, Artificial Sequence
  Description of Artificial Sequence: Chemically synthesized oligonucleotide
acaggaggccaaatagagg

SEQ ID NO: 10072 - DNA, 19 bp, Artificial Sequence
  Description of Artificial Sequence: Chemically synthesized oligonucleotide
cctctatttggcctcctgt

SEQ ID NO: 10073 - DNA, 19 bp, Artificial Sequence
  Description of Artificial Sequence: Chemically synthesized oligonucleotide
caggaggccaaatagaggg

SEQ ID NO: 10074 - DNA, 19 bp, Artificial Sequence
  Description of Artificial Sequence: Chemically synthesized oligonucleotide
ccctctatttggcctcctg

SEQ ID NO: 10075 - DNA, 19 bp, Artificial Sequence
  Description of Artificial Sequence: Chemically synthesized oligonucleotide
aggaggccaaatagaggga

SEQ ID NO: 10076 - DNA, 19 bp, Artificial Sequence
  Description of Artificial Sequence: Chemically synthesized oligonucleotide
tccctctatttggcctcct

SEQ ID NO: 10077 - DNA, 19 bp, Artificial Sequence
  Description of Artificial Sequence: Chemically synthesized oligonucleotide
ggaggccaaatagagggat

SEQ ID NO: 10078 - DNA, 19 bp, Artificial Sequence
  Description of Artificial Sequence: Chemically synthesized oligonucleotide
atccctctatttggcctcc

SEQ ID NO: 10079 - DNA, 19 bp, Artificial Sequence
  Description of Artificial Sequence: Chemically synthesized oligonucleotide
gaggccaaatagagggatg

SEQ ID NO: 10080 - DNA, 19 bp, Artificial Sequence
  Description of Artificial Sequence: Chemically synthesized oligonucleotide
catccctctatttggcctc

SEQ ID NO: 10081 - DNA, 19 bp, Artificial Sequence
  Description of Artificial Sequence: Chemically synthesized oligonucleotide
aggccaaatagagggatgc

SEQ ID NO: 10082 - DNA, 19 bp, Artificial Sequence
  Description of Artificial Sequence: Chemically synthesized oligonucleotide
gcatccctctatttggcct

SEQ ID NO: 10083 - DNA, 19 bp, Artificial Sequence
  Description of Artificial Sequence: Chemically synthesized oligonucleotide
ggccaaatagagggatgct

SEQ ID NO: 10084 - DNA, 19 bp, Artificial Sequence
  Description of Artificial Sequence: Chemically synthesized oligonucleotide
agcatccctctatttggcc

SEQ ID NO: 10085 - DNA, 19 bp, Artificial Sequence
  Description of Artificial Sequence: Chemically synthesized oligonucleotide
gccaaatagagggatgcta

SEQ ID NO: 10086 - DNA, 19 bp, Artificial Sequence
  Description of Artificial Sequence: Chemically synthesized oligonucleotide
tagcatccctctatttggc

SEQ ID NO: 10087 - DNA, 19 bp, Artificial Sequence
  Description of Artificial Sequence: Chemically synthesized oligonucleotide
ccaaatagagggatgctag

SEQ ID NO: 10088 - DNA, 19 bp, Artificial Sequence
  Description of Artificial Sequence: Chemically synthesized oligonucleotide
ctagcatccctctatttgg

SEQ ID NO: 10089 - DNA, 19 bp, Artificial Sequence
  Description of Artificial Sequence: Chemically synthesized oligonucleotide
caaatagagggatgctagg

SEQ ID NO: 10090 - DNA, 19 bp, Artificial Sequence
  Description of Artificial Sequence: Chemically synthesized oligonucleotide
cctagcatccctctatttg

SEQ ID NO: 10091 - DNA, 19 bp, Artificial Sequence
  Description of Artificial Sequence: Chemically synthesized oligonucleotide
aaatagagggatgctaggt

SEQ ID NO: 10092 - DNA, 19 bp, Artificial Sequence
  Description of Artificial Sequence: Chemically synthesized oligonucleotide
acctagcatccctctattt

SEQ ID NO: 10093 - DNA, 19 bp, Artificial Sequence
  Description of Artificial Sequence: Chemically synthesized oligonucleotide
aatagagggatgctaggtg

SEQ ID NO: 10094 - DNA, 19 bp, Artificial Sequence
  Description of Artificial Sequence: Chemically synthesized oligonucleotide
cacctagcatccctctatt

SEQ ID NO: 10095 - DNA, 19 bp, Artificial Sequence
  Description of Artificial Sequence: Chemically synthesized oligonucleotide
atagagggatgctaggtgt

SEQ ID NO: 10096 - DNA, 19 bp, Artificial Sequence
  Description of Artificial Sequence: Chemically synthesized oligonucleotide
acacctagcatccctctat

SEQ ID NO: 10097 - DNA, 19 bp, Artificial Sequence
  Description of Artificial Sequence: Chemically synthesized oligonucleotide
tagagggatgctaggtgtc

SEQ ID NO: 10098 - DNA, 19 bp, Artificial Sequence
  Description of Artificial Sequence: Chemically synthesized oligonucleotide
gacacctagcatccctcta

SEQ ID NO: 10099 - DNA, 19 bp, Artificial Sequence
  Description of Artificial Sequence: Chemically synthesized oligonucleotide
agagggatgctaggtgtct

SEQ ID NO: 10100 - DNA, 19 bp, Artificial Sequence
  Description of Artificial Sequence: Chemically synthesized oligonucleotide
agacacctagcatccctct

SEQ ID NO: 10101 - DNA, 19 bp, Artificial Sequence
  Description of Artificial Sequence: Chemically synthesized oligonucleotide
gagggatgctaggtgtctg

SEQ ID NO: 10102 - DNA, 19 bp, Artificial Sequence
  Description of Artificial Sequence: Chemically synthesized oligonucleotide
cagacacctagcatccctc

SEQ ID NO: 10103 - DNA, 19 bp, Artificial Sequence
  Description of Artificial Sequence: Chemically synthesized oligonucleotide
agggatgctaggtgtctgg

SEQ ID NO: 10104 - DNA, 19 bp, Artificial Sequence
  Description of Artificial Sequence: Chemically synthesized oligonucleotide
ccagacacctagcatccct

SEQ ID NO: 10105 - DNA, 19 bp, Artificial Sequence
  Description of Artificial Sequence: Chemically synthesized oligonucleotide
gggatgctaggtgtctggg

SEQ ID NO: 10106 - DNA, 19 bp, Artificial Sequence
  Description of Artificial Sequence: Chemically synthesized oligonucleotide
cccagacacctagcatccc

SEQ ID NO: 10107 - DNA, 19 bp, Artificial Sequence
  Description of Artificial Sequence: Chemically synthesized oligonucleotide
ggatgctaggtgtctggga

SEQ ID NO: 10108 - DNA, 19 bp, Artificial Sequence
  Description of Artificial Sequence: Chemically synthesized oligonucleotide
tcccagacacctagcatcc

SEQ ID NO: 10109 - DNA, 19 bp, Artificial Sequence
  Description of Artificial Sequence: Chemically synthesized oligonucleotide
gatgctaggtgtctgggat

SEQ ID NO: 10110 - DNA, 19 bp, Artificial Sequence
  Description of Artificial Sequence: Chemically synthesized oligonucleotide
atcccagacacctagcatc

SEQ ID NO: 10111 - DNA, 19 bp, Artificial Sequence
  Description of Artificial Sequence: Chemically synthesized oligonucleotide
atgctaggtgtctgggatc

SEQ ID NO: 10112 - DNA, 19 bp, Artificial Sequence
  Description of Artificial Sequence: Chemically synthesized oligonucleotide
gatcccagacacctagcat

SEQ ID NO: 10113 - DNA, 19 bp, Artificial Sequence
  Description of Artificial Sequence: Chemically synthesized oligonucleotide
tgctaggtgtctgggatcg

SEQ ID NO: 10114 - DNA, 19 bp, Artificial Sequence
  Description of Artificial Sequence: Chemically synthesized oligonucleotide
cgatcccagacacctagca

SEQ ID NO: 10115 - DNA, 19 bp, Artificial Sequence
  Description of Artificial Sequence: Chemically synthesized oligonucleotide
gctaggtgtctgggatcgg

SEQ ID NO: 10116 - DNA, 19 bp, Artificial Sequence
  Description of Artificial Sequence: Chemically synthesized oligonucleotide
ccgatcccagacacctagc

SEQ ID NO: 10117 - DNA, 19 bp, Artificial Sequence
  Description of Artificial Sequence: Chemically synthesized oligonucleotide
ctaggtgtctgggatcggg

SEQ ID NO: 10118 - DNA, 19 bp, Artificial Sequence
  Description of Artificial Sequence: Chemically synthesized oligonucleotide
cccgatcccagacacctag

SEQ ID NO: 10119 - DNA, 19 bp, Artificial Sequence
  Description of Artificial Sequence: Chemically synthesized oligonucleotide
taggtgtctgggatcgggg

SEQ ID NO: 10120 - DNA, 19 bp, Artificial Sequence
  Description of Artificial Sequence: Chemically synthesized oligonucleotide
ccccgatcccagacaccta

SEQ ID NO: 10121 - DNA, 19 bp, Artificial Sequence
  Description of Artificial Sequence: Chemically synthesized oligonucleotide
aggtgtctgggatcggggt

SEQ ID NO: 10122 - DNA, 19 bp, Artificial Sequence
  Description of Artificial Sequence: Chemically synthesized oligonucleotide
accccgatcccagacacct

SEQ ID NO: 10123 - DNA, 19 bp, Artificial Sequence
  Description of Artificial Sequence: Chemically synthesized oligonucleotide
ggtgtctgggatcggggtg

SEQ ID NO: 10124 - DNA, 19 bp, Artificial Sequence
  Description of Artificial Sequence: Chemically synthesized oligonucleotide
caccccgatcccagacacc

SEQ ID NO: 10125 - DNA, 19 bp, Artificial Sequence
  Description of Artificial Sequence: Chemically synthesized oligonucleotide
gtgtctgggatcggggtgg

SEQ ID NO: 10126 - DNA, 19 bp, Artificial Sequence
  Description of Artificial Sequence: Chemically synthesized oligonucleotide
ccaccccgatcccagacac

SEQ ID NO: 10127 - DNA, 19 bp, Artificial Sequence
  Description of Artificial Sequence: Chemically synthesized oligonucleotide
tgtctgggatcggggtggg

SEQ ID NO: 10128 - DNA, 19 bp, Artificial Sequence
  Description of Artificial Sequence: Chemically synthesized oligonucleotide
cccaccccgatcccagaca

SEQ ID NO: 10129 - DNA, 19 bp, Artificial Sequence
  Description of Artificial Sequence: Chemically synthesized oligonucleotide
gtctgggatcggggtgggg

SEQ ID NO: 10130 - DNA, 19 bp, Artificial Sequence
  Description of Artificial Sequence: Chemically synthesized oligonucleotide
ccccaccccgatcccagac

SEQ ID NO: 10131 - DNA, 19 bp, Artificial Sequence
  Description of Artificial Sequence: Chemically synthesized oligonucleotide
tctgggatcggggtgggga

SEQ ID NO: 10132 - DNA, 19 bp, Artificial Sequence
  Description of Artificial Sequence: Chemically synthesized oligonucleotide
tccccaccccgatcccaga

SEQ ID NO: 10133 - DNA, 19 bp, Artificial Sequence
  Description of Artificial Sequence: Chemically synthesized oligonucleotide
ctgggatcggggtggggac

SEQ ID NO: 10134 - DNA, 19 bp, Artificial Sequence
  Description of Artificial Sequence: Chemically synthesized oligonucleotide
gtccccaccccgatcccag

SEQ ID NO: 10135 - DNA, 19 bp, Artificial Sequence
  Description of Artificial Sequence: Chemically synthesized oligonucleotide
tgggatcggggtggggaca

SEQ ID NO: 10136 - DNA, 19 bp, Artificial Sequence
  Description of Artificial Sequence: Chemically synthesized oligonucleotide
tgtccccaccccgatccca

SEQ ID NO: 10137 - DNA, 19 bp, Artificial Sequence
  Description of Artificial Sequence: Chemically synthesized oligonucleotide
gggatcggggtggggacag

SEQ ID NO: 10138 - DNA, 19 bp, Artificial Sequence
  Description of Artificial Sequence: Chemically synthesized oligonucleotide
ctgtccccaccccgatccc

SEQ ID NO: 10139 - DNA, 19 bp, Artificial Sequence
  Description of Artificial Sequence: Chemically synthesized oligonucleotide
ggatcggggtggggacagg

SEQ ID NO: 10140 - DNA, 19 bp, Artificial Sequence
  Description of Artificial Sequence: Chemically synthesized oligonucleotide
cctgtccccaccccgatcc

SEQ ID NO: 10141 - DNA, 19 bp, Artificial Sequence
  Description of Artificial Sequence: Chemically synthesized oligonucleotide
gatcggggtggggacaggt

SEQ ID NO: 10142 - DNA, 19 bp, Artificial Sequence
  Description of Artificial Sequence: Chemically synthesized oligonucleotide
acctgtccccaccccgatc

SEQ ID NO: 10143 - DNA, 19 bp, Artificial Sequence
  Description of Artificial Sequence: Chemically synthesized oligonucleotide
atcggggtggggacaggta

SEQ ID NO: 10144 - DNA, 19 bp, Artificial Sequence
  Description of Artificial Sequence: Chemically synthesized oligonucleotide
tacctgtccccaccccgat

SEQ ID NO: 10145 - DNA, 19 bp, Artificial Sequence
  Description of Artificial Sequence: Chemically synthesized oligonucleotide
tcggggtggggacaggtag

SEQ ID NO: 10146 - DNA, 19 bp, Artificial Sequence
  Description of Artificial Sequence: Chemically synthesized oligonucleotide
ctacctgtccccaccccga

SEQ ID NO: 10147 - DNA, 19 bp, Artificial Sequence
  Description of Artificial Sequence: Chemically synthesized oligonucleotide
cggggtggggacaggtaga

SEQ ID NO: 10148 - DNA, 19 bp, Artificial Sequence
  Description of Artificial Sequence: Chemically synthesized oligonucleotide
tctacctgtccccaccccg

SEQ ID NO: 10149 - DNA, 19 bp, Artificial Sequence
  Description of Artificial Sequence: Chemically synthesized oligonucleotide
ggggtggggacaggtagac

SEQ ID NO: 10150 - DNA, 19 bp, Artificial Sequence
  Description of Artificial Sequence: Chemically synthesized oligonucleotide
gtctacctgtccccacccc

SEQ ID NO: 10151 - DNA, 19 bp, Artificial Sequence
  Description of Artificial Sequence: Chemically synthesized oligonucleotide
gggtggggacaggtagacc

SEQ ID NO: 10152 - DNA, 19 bp, Artificial Sequence
  Description of Artificial Sequence: Chemically synthesized oligonucleotide
ggtctacctgtccccaccc

SEQ ID NO: 10153 - DNA, 19 bp, Artificial Sequence
  Description of Artificial Sequence: Chemically synthesized oligonucleotide
ggtggggacaggtagacca

SEQ ID NO: 10154 - DNA, 19 bp, Artificial Sequence
  Description of Artificial Sequence: Chemically synthesized oligonucleotide
tggtctacctgtccccacc

SEQ ID NO: 10155 - DNA, 19 bp, Artificial Sequence
  Description of Artificial Sequence: Chemically synthesized oligonucleotide
gtggggacaggtagaccag

SEQ ID NO: 10156 - DNA, 19 bp, Artificial Sequence
  Description of Artificial Sequence: Chemically synthesized oligonucleotide
ctggtctacctgtccccac

SEQ ID NO: 10157 - DNA, 19 bp, Artificial Sequence
  Description of Artificial Sequence: Chemically synthesized oligonucleotide
tggggacaggtagaccagg

SEQ ID NO: 10158 - DNA, 19 bp, Artificial Sequence
  Description of Artificial Sequence: Chemically synthesized oligonucleotide
cctggtctacctgtcccca

SEQ ID NO: 10159 - DNA, 19 bp, Artificial Sequence
  Description of Artificial Sequence: Chemically synthesized oligonucleotide
ggggacaggtagaccaggt

SEQ ID NO: 10160 - DNA, 19 bp, Artificial Sequence
  Description of Artificial Sequence: Chemically synthesized oligonucleotide
acctggtctacctgtcccc

SEQ ID NO: 10161 - DNA, 19 bp, Artificial Sequence
  Description of Artificial Sequence: Chemically synthesized oligonucleotide
gggacaggtagaccaggtg

SEQ ID NO: 10162 - DNA, 19 bp, Artificial Sequence
  Description of Artificial Sequence: Chemically synthesized oligonucleotide
cacctggtctacctgtccc

SEQ ID NO: 10163 - DNA, 19 bp, Artificial Sequence
  Description of Artificial Sequence: Chemically synthesized oligonucleotide
ggacaggtagaccaggtgc

SEQ ID NO: 10164 - DNA, 19 bp, Artificial Sequence
  Description of Artificial Sequence: Chemically synthesized oligonucleotide
gcacctggtctacctgtcc

SEQ ID NO: 10165 - DNA, 19 bp, Artificial Sequence
  Description of Artificial Sequence: Chemically synthesized oligonucleotide
gacaggtagaccaggtgct

SEQ ID NO: 10166 - DNA, 19 bp, Artificial Sequence
  Description of Artificial Sequence: Chemically synthesized oligonucleotide
agcacctggtctacctgtc

SEQ ID NO: 10167 - DNA, 19 bp, Artificial Sequence
  Description of Artificial Sequence: Chemically synthesized oligonucleotide
acaggtagaccaggtgctc

SEQ ID NO: 10168 - DNA, 19 bp, Artificial Sequence
  Description of Artificial Sequence: Chemically synthesized oligonucleotide
gagcacctggtctacctgt

SEQ ID NO: 10169 - DNA, 19 bp, Artificial Sequence
  Description of Artificial Sequence: Chemically synthesized oligonucleotide
caggtagaccaggtgctca

SEQ ID NO: 10170 - DNA, 19 bp, Artificial Sequence
  Description of Artificial Sequence: Chemically synthesized oligonucleotide
tgagcacctggtctacctg

SEQ ID NO: 10171 - DNA, 19 bp, Artificial Sequence
  Description of Artificial Sequence: Chemically synthesized oligonucleotide
aggtagaccaggtgctcag

SEQ ID NO: 10172 - DNA, 19 bp, Artificial Sequence
  Description of Artificial Sequence: Chemically synthesized oligonucleotide
ctgagcacctggtctacct

SEQ ID NO: 10173 - DNA, 19 bp, Artificial Sequence
  Description of Artificial Sequence: Chemically synthesized oligonucleotide
ggtagaccaggtgctcagc

SEQ ID NO: 10174 - DNA, 19 bp, Artificial Sequence
  Description of Artificial Sequence: Chemically synthesized oligonucleotide
gctgagcacctggtctacc

SEQ ID NO: 10175 - DNA, 19 bp, Artificial Sequence
  Description of Artificial Sequence: Chemically synthesized oligonucleotide
gtagaccaggtgctcagcc

SEQ ID NO: 10176 - DNA, 19 bp, Artificial Sequence
  Description of Artificial Sequence: Chemically synthesized oligonucleotide
ggctgagcacctggtctac

SEQ ID NO: 10177 - DNA, 19 bp, Artificial Sequence
  Description of Artificial Sequence: Chemically synthesized oligonucleotide
tagaccaggtgctcagccc

SEQ ID NO: 10178 - DNA, 19 bp, Artificial Sequence
  Description of Artificial Sequence: Chemically synthesized oligonucleotide
gggctgagcacctggtcta

SEQ ID NO: 10179 - DNA, 19 bp, Artificial Sequence
  Description of Artificial Sequence: Chemically synthesized oligonucleotide
agaccaggtgctcagccca

SEQ ID NO: 10180 - DNA, 19 bp, Artificial Sequence
  Description of Artificial Sequence: Chemically synthesized oligonucleotide
tgggctgagcacctggtct

SEQ ID NO: 10181 - DNA, 19 bp, Artificial Sequence
  Description of Artificial Sequence: Chemically synthesized oligonucleotide
gaccaggtgctcagcccag

SEQ ID NO: 10182 - DNA, 19 bp, Artificial Sequence
  Description of Artificial Sequence: Chemically synthesized oligonucleotide
ctgggctgagcacctggtc

SEQ ID NO: 10183 - DNA, 19 bp, Artificial Sequence
  Description of Artificial Sequence: Chemically synthesized oligonucleotide
accaggtgctcagcccagg

SEQ ID NO: 10184 - DNA, 19 bp, Artificial Sequence
  Description of Artificial Sequence: Chemically synthesized oligonucleotide
cctgggctgagcacctggt

SEQ ID NO: 10185 - DNA, 19 bp, Artificial Sequence
  Description of Artificial Sequence: Chemically synthesized oligonucleotide
ccaggtgctcagcccaggc

SEQ ID NO: 10186 - DNA, 19 bp, Artificial Sequence
  Description of Artificial Sequence: Chemically synthesized oligonucleotide
gcctgggctgagcacctgg

SEQ ID NO: 10187 - DNA, 19 bp, Artificial Sequence
  Description of Artificial Sequence: Chemically synthesized oligonucleotide
caggtgctcagcccaggca

SEQ ID NO: 10188 - DNA, 19 bp, Artificial Sequence
  Description of Artificial Sequence: Chemically synthesized oligonucleotide
tgcctgggctgagcacctg

SEQ ID NO: 10189 - DNA, 19 bp, Artificial Sequence
  Description of Artificial Sequence: Chemically synthesized oligonucleotide
aggtgctcagcccaggcac

SEQ ID NO: 10190 - DNA, 19 bp, Artificial Sequence
  Description of Artificial Sequence: Chemically synthesized oligonucleotide
gtgcctgggctgagcacct

SEQ ID NO: 10191 - DNA, 19 bp, Artificial Sequence
  Description of Artificial Sequence: Chemically synthesized oligonucleotide
ggtgctcagcccaggcaca

SEQ ID NO: 10192 - DNA, 19 bp, Artificial Sequence
  Description of Artificial Sequence: Chemically synthesized oligonucleotide
tgtgcctgggctgagcacc

SEQ ID NO: 10193 - DNA, 19 bp, Artificial Sequence
  Description of Artificial Sequence: Chemically synthesized oligonucleotide
gtgctcagcccaggcacaa

SEQ ID NO: 10194 - DNA, 19 bp, Artificial Sequence
  Description of Artificial Sequence: Chemically synthesized oligonucleotide
ttgtgcctgggctgagcac

SEQ ID NO: 10195 - DNA, 19 bp, Artificial Sequence
  Description of Artificial Sequence: Chemically synthesized oligonucleotide
tgctcagcccaggcacaac

SEQ ID NO: 10196 - DNA, 19 bp, Artificial Sequence
  Description of Artificial Sequence: Chemically synthesized oligonucleotide
gttgtgcctgggctgagca

SEQ ID NO: 10197 - DNA, 19 bp, Artificial Sequence
  Description of Artificial Sequence: Chemically synthesized oligonucleotide
gctcagcccaggcacaact

SEQ ID NO: 10198 - DNA, 19 bp, Artificial Sequence
  Description of Artificial Sequence: Chemically synthesized oligonucleotide
agttgtgcctgggctgagc

SEQ ID NO: 10199 - DNA, 19 bp, Artificial Sequence
  Description of Artificial Sequence: Chemically synthesized oligonucleotide
ctcagcccaggcacaactt

SEQ ID NO: 10200 - DNA, 19 bp, Artificial Sequence
  Description of Artificial Sequence: Chemically synthesized oligonucleotide
aagttgtgcctgggctgag

SEQ ID NO: 10201 - DNA, 19 bp, Artificial Sequence
  Description of Artificial Sequence: Chemically synthesized oligonucleotide
tcagcccaggcacaacttc

SEQ ID NO: 10202 - DNA, 19 bp, Artificial Sequence
  Description of Artificial Sequence: Chemically synthesized oligonucleotide
gaagttgtgcctgggctga

SEQ ID NO: 10203 - DNA, 19 bp, Artificial Sequence
  Description of Artificial Sequence: Chemically synthesized oligonucleotide
cagcccaggcacaacttca

SEQ ID NO: 10204 - DNA, 19 bp, Artificial Sequence
  Description of Artificial Sequence: Chemically synthesized oligonucleotide
tgaagttgtgcctgggctg

SEQ ID NO: 10205 - DNA, 19 bp, Artificial Sequence
  Description of Artificial Sequence: Chemically synthesized oligonucleotide
agcccaggcacaacttcag

SEQ ID NO: 10206 - DNA, 19 bp, Artificial Sequence
  Description of Artificial Sequence: Chemically synthesized oligonucleotide
ctgaagttgtgcctgggct

SEQ ID NO: 10207 - DNA, 19 bp, Artificial Sequence
  Description of Artificial Sequence: Chemically synthesized oligonucleotide
gcccaggcacaacttcagc

SEQ ID NO: 10208 - DNA, 19 bp, Artificial Sequence
  Description of Artificial Sequence: Chemically synthesized oligonucleotide
gctgaagttgtgcctgggc

SEQ ID NO: 10209 - DNA, 19 bp, Artificial Sequence
  Description of Artificial Sequence: Chemically synthesized oligonucleotide
cccaggcacaacttcagca

SEQ ID NO: 10210 - DNA, 19 bp, Artificial Sequence
  Description of Artificial Sequence: Chemically synthesized oligonucleotide
tgctgaagttgtgcctggg

SEQ ID NO: 10211 - DNA, 19 bp, Artificial Sequence
  Description of Artificial Sequence: Chemically synthesized oligonucleotide
ccaggcacaacttcagcag

SEQ ID NO: 10212 - DNA, 19 bp, Artificial Sequence
  Description of Artificial Sequence: Chemically synthesized oligonucleotide
ctgctgaagttgtgcctgg

SEQ ID NO: 10213 - DNA, 19 bp, Artificial Sequence
  Description of Artificial Sequence: Chemically synthesized oligonucleotide
caggcacaacttcagcagg

SEQ ID NO: 10214 - DNA, 19 bp, Artificial Sequence
  Description of Artificial Sequence: Chemically synthesized oligonucleotide
cctgctgaagttgtgcctg

SEQ ID NO: 10215 - DNA, 19 bp, Artificial Sequence
  Description of Artificial Sequence: Chemically synthesized oligonucleotide
aggcacaacttcagcaggg

SEQ ID NO: 10216 - DNA, 19 bp, Artificial Sequence
  Description of Artificial Sequence: Chemically synthesized oligonucleotide
ccctgctgaagttgtgcct

SEQ ID NO: 10217 - DNA, 19 bp, Artificial Sequence
  Description of Artificial Sequence: Chemically synthesized oligonucleotide
ggcacaacttcagcagggg

SEQ ID NO: 10218 - DNA, 19 bp, Artificial Sequence
  Description of Artificial Sequence: Chemically synthesized oligonucleotide
cccctgctgaagttgtgcc

SEQ ID NO: 10219 - DNA, 19 bp, Artificial Sequence
  Description of Artificial Sequence: Chemically synthesized oligonucleotide
gcacaacttcagcagggga

SEQ ID NO: 10220 - DNA, 19 bp, Artificial Sequence
  Description of Artificial Sequence: Chemically synthesized oligonucleotide
tcccctgctgaagttgtgc

SEQ ID NO: 10221 - DNA, 19 bp, Artificial Sequence
  Description of Artificial Sequence: Chemically synthesized oligonucleotide
cacaacttcagcaggggat

SEQ ID NO: 10222 - DNA, 19 bp, Artificial Sequence
  Description of Artificial Sequence: Chemically synthesized oligonucleotide
atcccctgctgaagttgtg

SEQ ID NO: 10223 - DNA, 19 bp, Artificial Sequence
  Description of Artificial Sequence: Chemically synthesized oligonucleotide
acaacttcagcaggggatg

SEQ ID NO: 10224 - DNA, 19 bp, Artificial Sequence
  Description of Artificial Sequence: Chemically synthesized oligonucleotide
catcccctgctgaagttgt

SEQ ID NO: 10225 - DNA, 19 bp, Artificial Sequence
  Description of Artificial Sequence: Chemically synthesized oligonucleotide
caacttcagcaggggatgg

SEQ ID NO: 10226 - DNA, 19 bp, Artificial Sequence
  Description of Artificial Sequence: Chemically synthesized oligonucleotide
ccatcccctgctgaagttg

SEQ ID NO: 10227 - DNA, 19 bp, Artificial Sequence
  Description of Artificial Sequence: Chemically synthesized oligonucleotide
aacttcagcaggggatggc

SEQ ID NO: 10228 - DNA, 19 bp, Artificial Sequence
  Description of Artificial Sequence: Chemically synthesized oligonucleotide
gccatcccctgctgaagtt

SEQ ID NO: 10229 - DNA, 19 bp, Artificial Sequence
  Description of Artificial Sequence: Chemically synthesized oligonucleotide
acttcagcaggggatggcg

SEQ ID NO: 10230 - DNA, 19 bp, Artificial Sequence
  Description of Artificial Sequence: Chemically synthesized oligonucleotide
cgccatcccctgctgaagt

SEQ ID NO: 10231 - DNA, 19 bp, Artificial Sequence
  Description of Artificial Sequence: Chemically synthesized oligonucleotide
cttcagcaggggatggcgc

SEQ ID NO: 10232 - DNA, 19 bp, Artificial Sequence
  Description of Artificial Sequence: Chemically synthesized oligonucleotide
gcgccatcccctgctgaag

SEQ ID NO: 10233 - DNA, 19 bp, Artificial Sequence
  Description of Artificial Sequence: Chemically synthesized oligonucleotide
ttcagcaggggatggcgct

SEQ ID NO: 10234 - DNA, 19 bp, Artificial Sequence
  Description of Artificial Sequence: Chemically synthesized oligonucleotide
agcgccatcccctgctgaa

SEQ ID NO: 10235 - DNA, 19 bp, Artificial Sequence
  Description of Artificial Sequence: Chemically synthesized oligonucleotide
tcagcaggggatggcgcta

SEQ ID NO: 10236 - DNA, 19 bp, Artificial Sequence
  Description of Artificial Sequence: Chemically synthesized oligonucleotide
tagcgccatcccctgctga

SEQ ID NO: 10237 - DNA, 19 bp, Artificial Sequence
  Description of Artificial Sequence: Chemically synthesized oligonucleotide
cagcaggggatggcgctag

SEQ ID NO: 10238 - DNA, 19 bp, Artificial Sequence
  Description of Artificial Sequence: Chemically synthesized oligonucleotide
ctagcgccatcccctgctg

SEQ ID NO: 10239 - DNA, 19 bp, Artificial Sequence
  Description of Artificial Sequence: Chemically synthesized oligonucleotide
agcaggggatggcgctagg

SEQ ID NO: 10240 - DNA, 19 bp, Artificial Sequence
  Description of Artificial Sequence: Chemically synthesized oligonucleotide
cctagcgccatcccctgct

SEQ ID NO: 10241 - DNA, 19 bp, Artificial Sequence
  Description of Artificial Sequence: Chemically synthesized oligonucleotide
gcaggggatggcgctaggg

SEQ ID NO: 10242 - DNA, 19 bp, Artificial Sequence
  Description of Artificial Sequence: Chemically synthesized oligonucleotide
ccctagcgccatcccctgc

SEQ ID NO: 10243 - DNA, 19 bp, Artificial Sequence
  Description of Artificial Sequence: Chemically synthesized oligonucleotide
caggggatggcgctagggg

SEQ ID NO: 10244 - DNA, 19 bp, Artificial Sequence
  Description of Artificial Sequence: Chemically synthesized oligonucleotide
cccctagcgccatcccctg

SEQ ID NO: 10245 - DNA, 19 bp, Artificial Sequence
  Description of Artificial Sequence: Chemically synthesized oligonucleotide
aggggatggcgctagggga

SEQ ID NO: 10246 - DNA, 19 bp, Artificial Sequence
  Description of Artificial Sequence: Chemically synthesized oligonucleotide
tcccctagcgccatcccct

SEQ ID NO: 10247 - DNA, 19 bp, Artificial Sequence
  Description of Artificial Sequence: Chemically synthesized oligonucleotide
ggggatggcgctaggggac

SEQ ID NO: 10248 - DNA, 19 bp, Artificial Sequence
  Description of Artificial Sequence: Chemically synthesized oligonucleotide
gtcccctagcgccatcccc

SEQ ID NO: 10249 - DNA, 19 bp, Artificial Sequence
  Description of Artificial Sequence: Chemically synthesized oligonucleotide
gggatggcgctaggggact

SEQ ID NO: 10250 - DNA, 19 bp, Artificial Sequence
  Description of Artificial Sequence: Chemically synthesized oligonucleotide
agtcccctagcgccatccc

SEQ ID NO: 10251 - DNA, 19 bp, Artificial Sequence
  Description of Artificial Sequence: Chemically synthesized oligonucleotide
ggatggcgctaggggactt

SEQ ID NO: 10252 - DNA, 19 bp, Artificial Sequence
  Description of Artificial Sequence: Chemically synthesized oligonucleotide
aagtcccctagcgccatcc

SEQ ID NO: 10253 - DNA, 19 bp, Artificial Sequence
  Description of Artificial Sequence: Chemically synthesized oligonucleotide
gatggcgctaggggacttg

SEQ ID NO: 10254 - DNA, 19 bp, Artificial Sequence
  Description of Artificial Sequence: Chemically synthesized oligonucleotide
caagtcccctagcgccatc

SEQ ID NO: 10255 - DNA, 19 bp, Artificial Sequence
  Description of Artificial Sequence: Chemically synthesized oligonucleotide
atggcgctaggggacttgg

SEQ ID NO: 10256 - DNA, 19 bp, Artificial Sequence
  Description of Artificial Sequence: Chemically synthesized oligonucleotide
ccaagtcccctagcgccat

SEQ ID NO: 10257 - DNA, 19 bp, Artificial Sequence
  Description of Artificial Sequence: Chemically synthesized oligonucleotide
tggcgctaggggacttggg

SEQ ID NO: 10258 - DNA, 19 bp, Artificial Sequence
  Description of Artificial Sequence: Chemically synthesized oligonucleotide
cccaagtcccctagcgcca

SEQ ID NO: 10259 - DNA, 19 bp, Artificial Sequence
  Description of Artificial Sequence: Chemically synthesized oligonucleotide
ggcgctaggggacttgggg

SEQ ID NO: 10260 - DNA, 19 bp, Artificial Sequence
  Description of Artificial Sequence: Chemically synthesized oligonucleotide
ccccaagtcccctagcgcc

SEQ ID NO: 10261 - DNA, 19 bp, Artificial Sequence
  Description of Artificial Sequence: Chemically synthesized oligonucleotide
gcgctaggggacttgggga

SEQ ID NO: 10262 - DNA, 19 bp, Artificial Sequence
  Description of Artificial Sequence: Chemically synthesized oligonucleotide
tccccaagtcccctagcgc

SEQ ID NO: 10263 - DNA, 19 bp, Artificial Sequence
  Description of Artificial Sequence: Chemically synthesized oligonucleotide
cgctaggggacttggggat

SEQ ID NO: 10264 - DNA, 19 bp, Artificial Sequence
  Description of Artificial Sequence: Chemically synthesized oligonucleotide
atccccaagtcccctagcg

SEQ ID NO: 10265 - DNA, 19 bp, Artificial Sequence
  Description of Artificial Sequence: Chemically synthesized oligonucleotide
gctaggggacttggggatt

SEQ ID NO: 10266 - DNA, 19 bp, Artificial Sequence
  Description of Artificial Sequence: Chemically synthesized oligonucleotide
aatccccaagtcccctagc

SEQ ID NO: 10267 - DNA, 19 bp, Artificial Sequence
  Description of Artificial Sequence: Chemically synthesized oligonucleotide
ctaggggacttggggattt

SEQ ID NO: 10268 - DNA, 19 bp, Artificial Sequence
  Description of Artificial Sequence: Chemically synthesized oligonucleotide
aaatccccaagtcccctag

SEQ ID NO: 10269 - DNA, 19 bp, Artificial Sequence
  Description of Artificial Sequence: Chemically synthesized oligonucleotide
taggggacttggggatttc

SEQ ID NO: 10270 - DNA, 19 bp, Artificial Sequence
  Description of Artificial Sequence: Chemically synthesized oligonucleotide
gaaatccccaagtccccta

SEQ ID NO: 10271 - DNA, 19 bp, Artificial Sequence
  Description of Artificial Sequence: Chemically synthesized oligonucleotide
aggggacttggggatttct

SEQ ID NO: 10272 - DNA, 19 bp, Artificial Sequence
  Description of Artificial Sequence: Chemically synthesized oligonucleotide
agaaatccccaagtcccct

SEQ ID NO: 10273 - DNA, 19 bp, Artificial Sequence
  Description of Artificial Sequence: Chemically synthesized oligonucleotide
ggggacttggggatttctg

SEQ ID NO: 10274 - DNA, 19 bp, Artificial Sequence
  Description of Artificial Sequence: Chemically synthesized oligonucleotide
cagaaatccccaagtcccc

SEQ ID NO: 10275 - DNA, 19 bp, Artificial Sequence
  Description of Artificial Sequence: Chemically synthesized oligonucleotide
gggacttggggatttctgg

SEQ ID NO: 10276 - DNA, 19 bp, Artificial Sequence
  Description of Artificial Sequence: Chemically synthesized oligonucleotide
ccagaaatccccaagtccc

SEQ ID NO: 10277 - DNA, 19 bp, Artificial Sequence
  Description of Artificial Sequence: Chemically synthesized oligonucleotide
ggacttggggatttctggt

SEQ ID NO: 10278 - DNA, 19 bp, Artificial Sequence
  Description of Artificial Sequence: Chemically synthesized oligonucleotide
accagaaatccccaagtcc

SEQ ID NO: 10279 - DNA, 19 bp, Artificial Sequence
  Description of Artificial Sequence: Chemically synthesized oligonucleotide
gacttggggatttctggtc

SEQ ID NO: 10280 - DNA, 19 bp, Artificial Sequence
  Description of Artificial Sequence: Chemically synthesized oligonucleotide
gaccagaaatccccaagtc

SEQ ID NO: 10281 - DNA, 19 bp, Artificial Sequence
  Description of Artificial Sequence: Chemically synthesized oligonucleotide
acttggggatttctggtca

SEQ ID NO: 10282 - DNA, 19 bp, Artificial Sequence
  Description of Artificial Sequence: Chemically synthesized oligonucleotide
tgaccagaaatccccaagt

SEQ ID NO: 10283 - DNA, 19 bp, Artificial Sequence
  Description of Artificial Sequence: Chemically synthesized oligonucleotide
cttggggatttctggtcaa

SEQ ID NO: 10284 - DNA, 19 bp, Artificial Sequence
  Description of Artificial Sequence: Chemically synthesized oligonucleotide
ttgaccagaaatccccaag

SEQ ID NO: 10285 - DNA, 19 bp, Artificial Sequence
  Description of Artificial Sequence: Chemically synthesized oligonucleotide
ttggggatttctggtcaac

SEQ ID NO: 10286 - DNA, 19 bp, Artificial Sequence
  Description of Artificial Sequence: Chemically synthesized oligonucleotide
gttgaccagaaatccccaa

SEQ ID NO: 10287 - DNA, 19 bp, Artificial Sequence
  Description of Artificial Sequence: Chemically synthesized oligonucleotide
tggggatttctggtcaacc

SEQ ID NO: 10288 - DNA, 19 bp, Artificial Sequence
  Description of Artificial Sequence: Chemically synthesized oligonucleotide
ggttgaccagaaatcccca

SEQ ID NO: 10289 - DNA, 19 bp, Artificial Sequence
  Description of Artificial Sequence: Chemically synthesized oligonucleotide
ggggatttctggtcaaccc

SEQ ID NO: 10290 - DNA, 19 bp, Artificial Sequence
  Description of Artificial Sequence: Chemically synthesized oligonucleotide
gggttgaccagaaatcccc

SEQ ID NO: 10291 - DNA, 19 bp, Artificial Sequence
  Description of Artificial Sequence: Chemically synthesized oligonucleotide
gggatttctggtcaacccc

SEQ ID NO: 10292 - DNA, 19 bp, Artificial Sequence
  Description of Artificial Sequence: Chemically synthesized oligonucleotide
ggggttgaccagaaatccc

SEQ ID NO: 10293 - DNA, 19 bp, Artificial Sequence
  Description of Artificial Sequence: Chemically synthesized oligonucleotide
ggatttctggtcaacccca

SEQ ID NO: 10294 - DNA, 19 bp, Artificial Sequence
  Description of Artificial Sequence: Chemically synthesized oligonucleotide
tggggttgaccagaaatcc

SEQ ID NO: 10295 - DNA, 19 bp, Artificial Sequence
  Description of Artificial Sequence: Chemically synthesized oligonucleotide
gatttctggtcaaccccac

SEQ ID NO: 10296 - DNA, 19 bp, Artificial Sequence
  Description of Artificial Sequence: Chemically synthesized oligonucleotide
gtggggttgaccagaaatc

SEQ ID NO: 10297 - DNA, 19 bp, Artificial Sequence
  Description of Artificial Sequence: Chemically synthesized oligonucleotide
atttctggtcaaccccaca

SEQ ID NO: 10298 - DNA, 19 bp, Artificial Sequence
  Description of Artificial Sequence: Chemically synthesized oligonucleotide
tgtggggttgaccagaaat

SEQ ID NO: 10299 - DNA, 19 bp, Artificial Sequence
  Description of Artificial Sequence: Chemically synthesized oligonucleotide
tttctggtcaaccccacaa

SEQ ID NO: 10300 - DNA, 19 bp, Artificial Sequence
  Description of Artificial Sequence: Chemically synthesized oligonucleotide
ttgtggggttgaccagaaa

SEQ ID NO: 10301 - DNA, 19 bp, Artificial Sequence
  Description of Artificial Sequence: Chemically synthesized oligonucleotide
ttctggtcaaccccacaag

SEQ ID NO: 10302 - DNA, 19 bp, Artificial Sequence
  Description of Artificial Sequence: Chemically synthesized oligonucleotide
cttgtggggttgaccagaa

SEQ ID NO: 10303 - DNA, 19 bp, Artificial Sequence
  Description of Artificial Sequence: Chemically synthesized oligonucleotide
tctggtcaaccccacaagc

SEQ ID NO: 10304 - DNA, 19 bp, Artificial Sequence
  Description of Artificial Sequence: Chemically synthesized oligonucleotide
gcttgtggggttgaccaga

SEQ ID NO: 10305 - DNA, 19 bp, Artificial Sequence
  Description of Artificial Sequence: Chemically synthesized oligonucleotide
ctggtcaaccccacaagca

SEQ ID NO: 10306 - DNA, 19 bp, Artificial Sequence
  Description of Artificial Sequence: Chemically synthesized oligonucleotide
tgcttgtggggttgaccag

SEQ ID NO: 10307 - DNA, 19 bp, Artificial Sequence
  Description of Artificial Sequence: Chemically synthesized oligonucleotide
tggtcaaccccacaagcac

SEQ ID NO: 10308 - DNA, 19 bp, Artificial Sequence
  Description of Artificial Sequence: Chemically synthesized oligonucleotide
gtgcttgtggggttgacca

SEQ ID NO: 10309 - DNA, 19 bp, Artificial Sequence
  Description of Artificial Sequence: Chemically synthesized oligonucleotide
ggtcaaccccacaagcacc

SEQ ID NO: 10310 - DNA, 19 bp, Artificial Sequence
  Description of Artificial Sequence: Chemically synthesized oligonucleotide
ggtgcttgtggggttgacc

SEQ ID NO: 10311 - DNA, 19 bp, Artificial Sequence
  Description of Artificial Sequence: Chemically synthesized oligonucleotide
gtcaaccccacaagcacca

SEQ ID NO: 10312 - DNA, 19 bp, Artificial Sequence
  Description of Artificial Sequence: Chemically synthesized oligonucleotide
tggtgcttgtggggttgac

SEQ ID NO: 10313 - DNA, 19 bp, Artificial Sequence
  Description of Artificial Sequence: Chemically synthesized oligonucleotide
tcaaccccacaagcaccac

SEQ ID NO: 10314 - DNA, 19 bp, Artificial Sequence
  Description of Artificial Sequence: Chemically synthesized oligonucleotide
gtggtgcttgtggggttga

SEQ ID NO: 10315 - DNA, 19 bp, Artificial Sequence
  Description of Artificial Sequence: Chemically synthesized oligonucleotide
caaccccacaagcaccact

SEQ ID NO: 10316 - DNA, 19 bp, Artificial Sequence
  Description of Artificial Sequence: Chemically synthesized oligonucleotide
agtggtgcttgtggggttg

SEQ ID NO: 10317 - DNA, 19 bp, Artificial Sequence
  Description of Artificial Sequence: Chemically synthesized oligonucleotide
aaccccacaagcaccactc

SEQ ID NO: 10318 - DNA, 19 bp, Artificial Sequence
  Description of Artificial Sequence: Chemically synthesized oligonucleotide
gagtggtgcttgtggggtt

SEQ ID NO: 10319 - DNA, 19 bp, Artificial Sequence
  Description of Artificial Sequence: Chemically synthesized oligonucleotide
accccacaagcaccactct

SEQ ID NO: 10320 - DNA, 19 bp, Artificial Sequence
  Description of Artificial Sequence: Chemically synthesized oligonucleotide
agagtggtgcttgtggggt

SEQ ID NO: 10321 - DNA, 19 bp, Artificial Sequence
  Description of Artificial Sequence: Chemically synthesized oligonucleotide
ccccacaagcaccactctg

SEQ ID NO: 10322 - DNA, 19 bp, Artificial Sequence
  Description of Artificial Sequence: Chemically synthesized oligonucleotide
cagagtggtgcttgtgggg

SEQ ID NO: 10323 - DNA, 19 bp, Artificial Sequence
  Description of Artificial Sequence: Chemically synthesized oligonucleotide
cccacaagcaccactctgg

SEQ ID NO: 10324 - DNA, 19 bp, Artificial Sequence
  Description of Artificial Sequence: Chemically synthesized oligonucleotide
ccagagtggtgcttgtggg

SEQ ID NO: 10325 - DNA, 19 bp, Artificial Sequence
  Description of Artificial Sequence: Chemically synthesized oligonucleotide
ccacaagcaccactctggg

SEQ ID NO: 10326 - DNA, 19 bp, Artificial Sequence
  Description of Artificial Sequence: Chemically synthesized oligonucleotide
cccagagtggtgcttgtgg

SEQ ID NO: 10327 - DNA, 19 bp, Artificial Sequence
  Description of Artificial Sequence: Chemically synthesized oligonucleotide
cacaagcaccactctgggc

SEQ ID NO: 10328 - DNA, 19 bp, Artificial Sequence
  Description of Artificial Sequence: Chemically synthesized oligonucleotide
gcccagagtggtgcttgtg

SEQ ID NO: 10329 - DNA, 19 bp, Artificial Sequence
  Description of Artificial Sequence: Chemically synthesized oligonucleotide
acaagcaccactctgggca

SEQ ID NO: 10330 - DNA, 19 bp, Artificial Sequence
  Description of Artificial Sequence: Chemically synthesized oligonucleotide
tgcccagagtggtgcttgt

SEQ ID NO: 10331 - DNA, 19 bp, Artificial Sequence
  Description of Artificial Sequence: Chemically synthesized oligonucleotide
caagcaccactctgggcac

SEQ ID NO: 10332 - DNA, 19 bp, Artificial Sequence
  Description of Artificial Sequence: Chemically synthesized oligonucleotide
gtgcccagagtggtgcttg

SEQ ID NO: 10333 - DNA, 19 bp, Artificial Sequence
  Description of Artificial Sequence: Chemically synthesized oligonucleotide
aagcaccactctgggcaca

SEQ ID NO: 10334 - DNA, 19 bp, Artificial Sequence
  Description of Artificial Sequence: Chemically synthesized oligonucleotide
tgtgcccagagtggtgctt

SEQ ID NO: 10335 - DNA, 19 bp, Artificial Sequence
  Description of Artificial Sequence: Chemically synthesized oligonucleotide
agcaccactctgggcacaa

SEQ ID NO: 10336 - DNA, 19 bp, Artificial Sequence
  Description of Artificial Sequence: Chemically synthesized oligonucleotide
ttgtgcccagagtggtgct

SEQ ID NO: 10337 - DNA, 19 bp, Artificial Sequence
  Description of Artificial Sequence: Chemically synthesized oligonucleotide
gcaccactctgggcacaag

SEQ ID NO: 10338 - DNA, 19 bp, Artificial Sequence
  Description of Artificial Sequence: Chemically synthesized oligonucleotide
cttgtgcccagagtggtgc

SEQ ID NO: 10339 - DNA, 19 bp, Artificial Sequence
  Description of Artificial Sequence: Chemically synthesized oligonucleotide
caccactctgggcacaagc

SEQ ID NO: 10340 - DNA, 19 bp, Artificial Sequence
  Description of Artificial Sequence: Chemically synthesized oligonucleotide
gcttgtgcccagagtggtg

SEQ ID NO: 10341 - DNA, 19 bp, Artificial Sequence
  Description of Artificial Sequence: Chemically synthesized oligonucleotide
accactctgggcacaagca

SEQ ID NO: 10342 - DNA, 19 bp, Artificial Sequence
  Description of Artificial Sequence: Chemically synthesized oligonucleotide
tgcttgtgcccagagtggt

SEQ ID NO: 10343 - DNA, 19 bp, Artificial Sequence
  Description of Artificial Sequence: Chemically synthesized oligonucleotide
ccactctgggcacaagcag

SEQ ID NO: 10344 - DNA, 19 bp, Artificial Sequence
  Description of Artificial Sequence: Chemically synthesized oligonucleotide
ctgcttgtgcccagagtgg

SEQ ID NO: 10345 - DNA, 19 bp, Artificial Sequence
  Description of Artificial Sequence: Chemically synthesized oligonucleotide
cactctgggcacaagcagg

SEQ ID NO: 10346 - DNA, 19 bp, Artificial Sequence
  Description of Artificial Sequence: Chemically synthesized oligonucleotide
cctgcttgtgcccagagtg

SEQ ID NO: 10347 - DNA, 19 bp, Artificial Sequence
  Description of Artificial Sequence: Chemically synthesized oligonucleotide
actctgggcacaagcaggg

SEQ ID NO: 10348 - DNA, 19 bp, Artificial Sequence
  Description of Artificial Sequence: Chemically synthesized oligonucleotide
ccctgcttgtgcccagagt

SEQ ID NO: 10349 - DNA, 19 bp, Artificial Sequence
  Description of Artificial Sequence: Chemically synthesized oligonucleotide
ctctgggcacaagcagggc

SEQ ID NO: 10350 - DNA, 19 bp, Artificial Sequence
  Description of Artificial Sequence: Chemically synthesized oligonucleotide
gccctgcttgtgcccagag

SEQ ID NO: 10351 - DNA, 19 bp, Artificial Sequence
  Description of Artificial Sequence: Chemically synthesized oligonucleotide
tctgggcacaagcagggca

SEQ ID NO: 10352 - DNA, 19 bp, Artificial Sequence
  Description of Artificial Sequence: Chemically synthesized oligonucleotide
tgccctgcttgtgcccaga

SEQ ID NO: 10353 - DNA, 19 bp, Artificial Sequence
  Description of Artificial Sequence: Chemically synthesized oligonucleotide
ctgggcacaagcagggcac

SEQ ID NO: 10354 - DNA, 19 bp, Artificial Sequence
  Description of Artificial Sequence: Chemically synthesized oligonucleotide
gtgccctgcttgtgcccag

SEQ ID NO: 10355 - DNA, 19 bp, Artificial Sequence
  Description of Artificial Sequence: Chemically synthesized oligonucleotide
tgggcacaagcagggcact

SEQ ID NO: 10356 - DNA, 19 bp, Artificial Sequence
  Description of Artificial Sequence: Chemically synthesized oligonucleotide
agtgccctgcttgtgccca

SEQ ID NO: 10357 - DNA, 19 bp, Artificial Sequence
  Description of Artificial Sequence: Chemically synthesized oligonucleotide
gggcacaagcagggcactc

SEQ ID NO: 10358 - DNA, 19 bp, Artificial Sequence
  Description of Artificial Sequence: Chemically synthesized oligonucleotide
gagtgccctgcttgtgccc

SEQ ID NO: 10359 - DNA, 19 bp, Artificial Sequence
  Description of Artificial Sequence: Chemically synthesized oligonucleotide
ggcacaagcagggcactct

SEQ ID NO: 10360 - DNA, 19 bp, Artificial Sequence
  Description of Artificial Sequence: Chemically synthesized oligonucleotide
agagtgccctgcttgtgcc

SEQ ID NO: 10361 - DNA, 19 bp, Artificial Sequence
  Description of Artificial Sequence: Chemically synthesized oligonucleotide
gcacaagcagggcactctg

SEQ ID NO: 10362 - DNA, 19 bp, Artificial Sequence
  Description of Artificial Sequence: Chemically synthesized oligonucleotide
cagagtgccctgcttgtgc

SEQ ID NO: 10363 - DNA, 19 bp, Artificial Sequence
  Description of Artificial Sequence: Chemically synthesized oligonucleotide
cacaagcagggcactctgt

SEQ ID NO: 10364 - DNA, 19 bp, Artificial Sequence
  Description of Artificial Sequence: Chemically synthesized oligonucleotide
acagagtgccctgcttgtg

SEQ ID NO: 10365 - DNA, 19 bp, Artificial Sequence
  Description of Artificial Sequence: Chemically synthesized oligonucleotide
acaagcagggcactctgtt

SEQ ID NO: 10366 - DNA, 19 bp, Artificial Sequence
  Description of Artificial Sequence: Chemically synthesized oligonucleotide
aacagagtgccctgcttgt

SEQ ID NO: 10367 - DNA, 19 bp, Artificial Sequence
  Description of Artificial Sequence: Chemically synthesized oligonucleotide
caagcagggcactctgttc

SEQ ID NO: 10368 - DNA, 19 bp, Artificial Sequence
  Description of Artificial Sequence: Chemically synthesized oligonucleotide
gaacagagtgccctgcttg

SEQ ID NO: 10369 - DNA, 19 bp, Artificial Sequence
  Description of Artificial Sequence: Chemically synthesized oligonucleotide
aagcagggcactctgttcc

SEQ ID NO: 10370 - DNA, 19 bp, Artificial Sequence
  Description of Artificial Sequence: Chemically synthesized oligonucleotide
ggaacagagtgccctgctt

SEQ ID NO: 10371 - DNA, 19 bp, Artificial Sequence
  Description of Artificial Sequence: Chemically synthesized oligonucleotide
agcagggcactctgttccc

SEQ ID NO: 10372 - DNA, 19 bp, Artificial Sequence
  Description of Artificial Sequence: Chemically synthesized oligonucleotide
gggaacagagtgccctgct

SEQ ID NO: 10373 - DNA, 19 bp, Artificial Sequence
  Description of Artificial Sequence: Chemically synthesized oligonucleotide
gcagggcactctgttcccc

SEQ ID NO: 10374 - DNA, 19 bp, Artificial Sequence
  Description of Artificial Sequence: Chemically synthesized oligonucleotide
ggggaacagagtgccctgc

SEQ ID NO: 10375 - DNA, 19 bp, Artificial Sequence
  Description of Artificial Sequence: Chemically synthesized oligonucleotide
cagggcactctgttcccct

SEQ ID NO: 10376 - DNA, 19 bp, Artificial Sequence
  Description of Artificial Sequence: Chemically synthesized oligonucleotide
aggggaacagagtgccctg

SEQ ID NO: 10377 - DNA, 19 bp, Artificial Sequence
  Description of Artificial Sequence: Chemically synthesized oligonucleotide
agggcactctgttcccctc

SEQ ID NO: 10378 - DNA, 19 bp, Artificial Sequence
  Description of Artificial Sequence: Chemically synthesized oligonucleotide
gaggggaacagagtgccct

SEQ ID NO: 10379 - DNA, 19 bp, Artificial Sequence
  Description of Artificial Sequence: Chemically synthesized oligonucleotide
gggcactctgttcccctcc

SEQ ID NO: 10380 - DNA, 19 bp, Artificial Sequence
  Description of Artificial Sequence: Chemically synthesized oligonucleotide
ggaggggaacagagtgccc

SEQ ID NO: 10381 - DNA, 19 bp, Artificial Sequence
  Description of Artificial Sequence: Chemically synthesized oligonucleotide
ggcactctgttcccctccc

SEQ ID NO: 10382 - DNA, 19 bp, Artificial Sequence
  Description of Artificial Sequence: Chemically synthesized oligonucleotide
gggaggggaacagagtgcc

SEQ ID NO: 10383 - DNA, 19 bp, Artificial Sequence
  Description of Artificial Sequence: Chemically synthesized oligonucleotide
gcactctgttcccctcccc

SEQ ID NO: 10384 - DNA, 19 bp, Artificial Sequence
  Description of Artificial Sequence: Chemically synthesized oligonucleotide
ggggaggggaacagagtgc

SEQ ID NO: 10385 - DNA, 19 bp, Artificial Sequence
  Description of Artificial Sequence: Chemically synthesized oligonucleotide
cactctgttcccctccccc

SEQ ID NO: 10386 - DNA, 19 bp, Artificial Sequence
  Description of Artificial Sequence: Chemically synthesized oligonucleotide
gggggaggggaacagagtg

SEQ ID NO: 10387 - DNA, 19 bp, Artificial Sequence
  Description of Artificial Sequence: Chemically synthesized oligonucleotide
actctgttcccctccccct

SEQ ID NO: 10388 - DNA, 19 bp, Artificial Sequence
  Description of Artificial Sequence: Chemically synthesized oligonucleotide
agggggaggggaacagagt

SEQ ID NO: 10389 - DNA, 19 bp, Artificial Sequence
  Description of Artificial Sequence: Chemically synthesized oligonucleotide
ctctgttcccctccccctt

SEQ ID NO: 10390 - DNA, 19 bp, Artificial Sequence
  Description of Artificial Sequence: Chemically synthesized oligonucleotide
aagggggaggggaacagag

SEQ ID NO: 10391 - DNA, 19 bp, Artificial Sequence
  Description of Artificial Sequence: Chemically synthesized oligonucleotide
tctgttcccctccccctta

SEQ ID NO: 10392 - DNA, 19 bp, Artificial Sequence
  Description of Artificial Sequence: Chemically synthesized oligonucleotide
taagggggaggggaacaga

SEQ ID NO: 10393 - DNA, 19 bp, Artificial Sequence
  Description of Artificial Sequence: Chemically synthesized oligonucleotide
ctgttcccctcccccttaa

SEQ ID NO: 10394 - DNA, 19 bp, Artificial Sequence
  Description of Artificial Sequence: Chemically synthesized oligonucleotide
ttaagggggaggggaacag

SEQ ID NO: 10395 - DNA, 19 bp, Artificial Sequence
  Description of Artificial Sequence: Chemically synthesized oligonucleotide
tgttcccctcccccttaag

SEQ ID NO: 10396 - DNA, 19 bp, Artificial Sequence
  Description of Artificial Sequence: Chemically synthesized oligonucleotide
cttaagggggaggggaaca

SEQ ID NO: 10397 - DNA, 19 bp, Artificial Sequence
  Description of Artificial Sequence: Chemically synthesized oligonucleotide
gttcccctcccccttaagc

SEQ ID NO: 10398 - DNA, 19 bp, Artificial Sequence
  Description of Artificial Sequence: Chemically synthesized oligonucleotide
gcttaagggggaggggaac

SEQ ID NO: 10399 - DNA, 19 bp, Artificial Sequence
  Description of Artificial Sequence: Chemically synthesized oligonucleotide
ttcccctcccccttaagcc

SEQ ID NO: 10400 - DNA, 19 bp, Artificial Sequence
  Description of Artificial Sequence: Chemically synthesized oligonucleotide
ggcttaagggggaggggaa

SEQ ID NO: 10401 - DNA, 19 bp, Artificial Sequence
  Description of Artificial Sequence: Chemically synthesized oligonucleotide
tcccctcccccttaagcca

SEQ ID NO: 10402 - DNA, 19 bp, Artificial Sequence
  Description of Artificial Sequence: Chemically synthesized oligonucleotide
tggcttaagggggagggga

SEQ ID NO: 10403 - DNA, 19 bp, Artificial Sequence
  Description of Artificial Sequence: Chemically synthesized oligonucleotide
cccctcccccttaagccaa

SEQ ID NO: 10404 - DNA, 19 bp, Artificial Sequence
  Description of Artificial Sequence: Chemically synthesized oligonucleotide
ttggcttaagggggagggg

SEQ ID NO: 10405 - DNA, 19 bp, Artificial Sequence
  Description of Artificial Sequence: Chemically synthesized oligonucleotide
ccctcccccttaagccaac

SEQ ID NO: 10406 - DNA, 19 bp, Artificial Sequence
  Description of Artificial Sequence: Chemically synthesized oligonucleotide
gttggcttaagggggaggg

SEQ ID NO: 10407 - DNA, 19 bp, Artificial Sequence
  Description of Artificial Sequence: Chemically synthesized oligonucleotide
cctcccccttaagccaaca

SEQ ID NO: 10408 - DNA, 19 bp, Artificial Sequence
  Description of Artificial Sequence: Chemically synthesized oligonucleotide
tgttggcttaagggggagg

SEQ ID NO: 10409 - DNA, 19 bp, Artificial Sequence
  Description of Artificial Sequence: Chemically synthesized oligonucleotide
ctcccccttaagccaacaa

SEQ ID NO: 10410 - DNA, 19 bp, Artificial Sequence
  Description of Artificial Sequence: Chemically synthesized oligonucleotide
ttgttggcttaagggggag

SEQ ID NO: 10411 - DNA, 19 bp, Artificial Sequence
  Description of Artificial Sequence: Chemically synthesized oligonucleotide
tcccccttaagccaacaac

SEQ ID NO: 10412 - DNA, 19 bp, Artificial Sequence
  Description of Artificial Sequence: Chemically synthesized oligonucleotide
gttgttggcttaaggggga

SEQ ID NO: 10413 - DNA, 19 bp, Artificial Sequence
  Description of Artificial Sequence: Chemically synthesized oligonucleotide
cccccttaagccaacaacc

SEQ ID NO: 10414 - DNA, 19 bp, Artificial Sequence
  Description of Artificial Sequence: Chemically synthesized oligonucleotide
ggttgttggcttaaggggg

SEQ ID NO: 10415 - DNA, 19 bp, Artificial Sequence
  Description of Artificial Sequence: Chemically synthesized oligonucleotide
ccccttaagccaacaacca

SEQ ID NO: 10416 - DNA, 19 bp, Artificial Sequence
  Description of Artificial Sequence: Chemically synthesized oligonucleotide
tggttgttggcttaagggg

SEQ ID NO: 10417 - DNA, 19 bp, Artificial Sequence
  Description of Artificial Sequence: Chemically synthesized oligonucleotide
cccttaagccaacaaccac

SEQ ID NO: 10418 - DNA, 19 bp, Artificial Sequence
  Description of Artificial Sequence: Chemically synthesized oligonucleotide
gtggttgttggcttaaggg

SEQ ID NO: 10419 - DNA, 19 bp, Artificial Sequence
  Description of Artificial Sequence: Chemically synthesized oligonucleotide
ccttaagccaacaaccaca

SEQ ID NO: 10420 - DNA, 19 bp, Artificial Sequence
  Description of Artificial Sequence: Chemically synthesized oligonucleotide
tgtggttgttggcttaagg

SEQ ID NO: 10421 - DNA, 19 bp, Artificial Sequence
  Description of Artificial Sequence: Chemically synthesized oligonucleotide
cttaagccaacaaccacag

SEQ ID NO: 10422 - DNA, 19 bp, Artificial Sequence
  Description of Artificial Sequence: Chemically synthesized oligonucleotide
ctgtggttgttggcttaag

SEQ ID NO: 10423 - DNA, 19 bp, Artificial Sequence
  Description of Artificial Sequence: Chemically synthesized oligonucleotide
ttaagccaacaaccacagt

SEQ ID NO: 10424 - DNA, 19 bp, Artificial Sequence
  Description of Artificial Sequence: Chemically synthesized oligonucleotide
actgtggttgttggcttaa

SEQ ID NO: 10425 - DNA, 19 bp, Artificial Sequence
  Description of Artificial Sequence: Chemically synthesized oligonucleotide
taagccaacaaccacagtg

SEQ ID NO: 10426 - DNA, 19 bp, Artificial Sequence
  Description of Artificial Sequence: Chemically synthesized oligonucleotide
cactgtggttgttggctta

SEQ ID NO: 10427 - DNA, 19 bp, Artificial Sequence
  Description of Artificial Sequence: Chemically synthesized oligonucleotide
aagccaacaaccacagtgc

SEQ ID NO: 10428 - DNA, 19 bp, Artificial Sequence
  Description of Artificial Sequence: Chemically synthesized oligonucleotide
gcactgtggttgttggctt

SEQ ID NO: 10429 - DNA, 19 bp, Artificial Sequence
  Description of Artificial Sequence: Chemically synthesized oligonucleotide
agccaacaaccacagtgcc

SEQ ID NO: 10430 - DNA, 19 bp, Artificial Sequence
  Description of Artificial Sequence: Chemically synthesized oligonucleotide
ggcactgtggttgttggct

SEQ ID NO: 10431 - DNA, 19 bp, Artificial Sequence
  Description of Artificial Sequence: Chemically synthesized oligonucleotide
gccaacaaccacagtgcca

SEQ ID NO: 10432 - DNA, 19 bp, Artificial Sequence
  Description of Artificial Sequence: Chemically synthesized oligonucleotide
tggcactgtggttgttggc

SEQ ID NO: 10433 - DNA, 19 bp, Artificial Sequence
  Description of Artificial Sequence: Chemically synthesized oligonucleotide
ccaacaaccacagtgccac

SEQ ID NO: 10434 - DNA, 19 bp, Artificial Sequence
  Description of Artificial Sequence: Chemically synthesized oligonucleotide
gtggcactgtggttgttgg

SEQ ID NO: 10435 - DNA, 19 bp, Artificial Sequence
  Description of Artificial Sequence: Chemically synthesized oligonucleotide
caacaaccacagtgccacc

SEQ ID NO: 10436 - DNA, 19 bp, Artificial Sequence
  Description of Artificial Sequence: Chemically synthesized oligonucleotide
ggtggcactgtggttgttg

SEQ ID NO: 10437 - DNA, 19 bp, Artificial Sequence
  Description of Artificial Sequence: Chemically synthesized oligonucleotide
aacaaccacagtgccacca

SEQ ID NO: 10438 - DNA, 19 bp, Artificial Sequence
  Description of Artificial Sequence: Chemically synthesized oligonucleotide
tggtggcactgtggttgtt

SEQ ID NO: 10439 - DNA, 19 bp, Artificial Sequence
  Description of Artificial Sequence: Chemically synthesized oligonucleotide
acaaccacagtgccaccaa

SEQ ID NO: 10440 - DNA, 19 bp, Artificial Sequence
  Description of Artificial Sequence: Chemically synthesized oligonucleotide
ttggtggcactgtggttgt

SEQ ID NO: 10441 - DNA, 19 bp, Artificial Sequence
  Description of Artificial Sequence: Chemically synthesized oligonucleotide
caaccacagtgccaccaag

SEQ ID NO: 10442 - DNA, 19 bp, Artificial Sequence
  Description of Artificial Sequence: Chemically synthesized oligonucleotide
cttggtggcactgtggttg

SEQ ID NO: 10443 - DNA, 19 bp, Artificial Sequence
  Description of Artificial Sequence: Chemically synthesized oligonucleotide
aaccacagtgccaccaagc

SEQ ID NO: 10444 - DNA, 19 bp, Artificial Sequence
  Description of Artificial Sequence: Chemically synthesized oligonucleotide
gcttggtggcactgtggtt

SEQ ID NO: 10445 - DNA, 19 bp, Artificial Sequence
  Description of Artificial Sequence: Chemically synthesized oligonucleotide
accacagtgccaccaagct

SEQ ID NO: 10446 - DNA, 19 bp, Artificial Sequence
  Description of Artificial Sequence: Chemically synthesized oligonucleotide
agcttggtggcactgtggt

SEQ ID NO: 10447 - DNA, 19 bp, Artificial Sequence
  Description of Artificial Sequence: Chemically synthesized oligonucleotide
ccacagtgccaccaagctc

SEQ ID NO: 10448 - DNA, 19 bp, Artificial Sequence
  Description of Artificial Sequence: Chemically synthesized oligonucleotide
gagcttggtggcactgtgg

SEQ ID NO: 10449 - DNA, 19 bp, Artificial Sequence
  Description of Artificial Sequence: Chemically synthesized oligonucleotide
cacagtgccaccaagctca

SEQ ID NO: 10450 - DNA, 19 bp, Artificial Sequence
  Description of Artificial Sequence: Chemically synthesized oligonucleotide
tgagcttggtggcactgtg

SEQ ID NO: 10451 - DNA, 19 bp, Artificial Sequence
  Description of Artificial Sequence: Chemically synthesized oligonucleotide
acagtgccaccaagctcac

SEQ ID NO: 10452 - DNA, 19 bp, Artificial Sequence
  Description of Artificial Sequence: Chemically synthesized oligonucleotide
gtgagcttggtggcactgt

SEQ ID NO: 10453 - DNA, 19 bp, Artificial Sequence
  Description of Artificial Sequence: Chemically synthesized oligonucleotide
cagtgccaccaagctcaca

SEQ ID NO: 10454 - DNA, 19 bp, Artificial Sequence
  Description of Artificial Sequence: Chemically synthesized oligonucleotide
tgtgagcttggtggcactg

SEQ ID NO: 10455 - DNA, 19 bp, Artificial Sequence
  Description of Artificial Sequence: Chemically synthesized oligonucleotide
agtgccaccaagctcacac

SEQ ID NO: 10456 - DNA, 19 bp, Artificial Sequence
  Description of Artificial Sequence: Chemically synthesized oligonucleotide
gtgtgagcttggtggcact

SEQ ID NO: 10457 - DNA, 19 bp, Artificial Sequence
  Description of Artificial Sequence: Chemically synthesized oligonucleotide
gtgccaccaagctcacacc

SEQ ID NO: 10458 - DNA, 19 bp, Artificial Sequence
  Description of Artificial Sequence: Chemically synthesized oligonucleotide
ggtgtgagcttggtggcac

SEQ ID NO: 10459 - DNA, 19 bp, Artificial Sequence
  Description of Artificial Sequence: Chemically synthesized oligonucleotide
tgccaccaagctcacacct

SEQ ID NO: 10460 - DNA, 19 bp, Artificial Sequence
  Description of Artificial Sequence: Chemically synthesized oligonucleotide
aggtgtgagcttggtggca

SEQ ID NO: 10461 - DNA, 19 bp, Artificial Sequence
  Description of Artificial Sequence: Chemically synthesized oligonucleotide
gccaccaagctcacacctg

SEQ ID NO: 10462 - DNA, 19 bp, Artificial Sequence
  Description of Artificial Sequence: Chemically synthesized oligonucleotide
caggtgtgagcttggtggc

SEQ ID NO: 10463 - DNA, 19 bp, Artificial Sequence
  Description of Artificial Sequence: Chemically synthesized oligonucleotide
ccaccaagctcacacctgt

SEQ ID NO: 10464 - DNA, 19 bp, Artificial Sequence
  Description of Artificial Sequence: Chemically synthesized oligonucleotide
acaggtgtgagcttggtgg

SEQ ID NO: 10465 - DNA, 19 bp, Artificial Sequence
  Description of Artificial Sequence: Chemically synthesized oligonucleotide
caccaagctcacacctgtc

SEQ ID NO: 10466 - DNA, 19 bp, Artificial Sequence
  Description of Artificial Sequence: Chemically synthesized oligonucleotide
gacaggtgtgagcttggtg

SEQ ID NO: 10467 - DNA, 19 bp, Artificial Sequence
  Description of Artificial Sequence: Chemically synthesized oligonucleotide
accaagctcacacctgtcc

SEQ ID NO: 10468 - DNA, 19 bp, Artificial Sequence
  Description of Artificial Sequence: Chemically synthesized oligonucleotide
ggacaggtgtgagcttggt

SEQ ID NO: 10469 - DNA, 19 bp, Artificial Sequence
  Description of Artificial Sequence: Chemically synthesized oligonucleotide
ccaagctcacacctgtcct

SEQ ID NO: 10470 - DNA, 19 bp, Artificial Sequence
  Description of Artificial Sequence: Chemically synthesized oligonucleotide
aggacaggtgtgagcttgg

SEQ ID NO: 10471 - DNA, 19 bp, Artificial Sequence
  Description of Artificial Sequence: Chemically synthesized oligonucleotide
caagctcacacctgtcctt

SEQ ID NO: 10472 - DNA, 19 bp, Artificial Sequence
  Description of Artificial Sequence: Chemically synthesized oligonucleotide
aaggacaggtgtgagcttg

SEQ ID NO: 10473 - DNA, 19 bp, Artificial Sequence
  Description of Artificial Sequence: Chemically synthesized oligonucleotide
aagctcacacctgtccttc

SEQ ID NO: 10474 - DNA, 19 bp, Artificial Sequence
  Description of Artificial Sequence: Chemically synthesized oligonucleotide
gaaggacaggtgtgagctt

SEQ ID NO: 10475 - DNA, 19 bp, Artificial Sequence
  Description of Artificial Sequence: Chemically synthesized oligonucleotide
agctcacacctgtccttct

SEQ ID NO: 10476 - DNA, 19 bp, Artificial Sequence
  Description of Artificial Sequence: Chemically synthesized oligonucleotide
agaaggacaggtgtgagct

SEQ ID NO: 10477 - DNA, 19 bp, Artificial Sequence
  Description of Artificial Sequence: Chemically synthesized oligonucleotide
gctcacacctgtccttctc

SEQ ID NO: 10478 - DNA, 19 bp, Artificial Sequence
  Description of Artificial Sequence: Chemically synthesized oligonucleotide
gagaaggacaggtgtgagc

SEQ ID NO: 10479 - DNA, 19 bp, Artificial Sequence
  Description of Artificial Sequence: Chemically synthesized oligonucleotide
ctcacacctgtccttctca

SEQ ID NO: 10480 - DNA, 19 bp, Artificial Sequence
  Description of Artificial Sequence: Chemically synthesized oligonucleotide
tgagaaggacaggtgtgag

SEQ ID NO: 10481 - DNA, 19 bp, Artificial Sequence
  Description of Artificial Sequence: Chemically synthesized oligonucleotide
tcacacctgtccttctcag

SEQ ID NO: 10482 - DNA, 19 bp, Artificial Sequence
  Description of Artificial Sequence: Chemically synthesized oligonucleotide
ctgagaaggacaggtgtga

SEQ ID NO: 10483 - DNA, 19 bp, Artificial Sequence
  Description of Artificial Sequence: Chemically synthesized oligonucleotide
cacacctgtccttctcagg

SEQ ID NO: 10484 - DNA, 19 bp, Artificial Sequence
  Description of Artificial Sequence: Chemically synthesized oligonucleotide
cctgagaaggacaggtgtg

SEQ ID NO: 10485 - DNA, 19 bp, Artificial Sequence
  Description of Artificial Sequence: Chemically synthesized oligonucleotide
acacctgtccttctcaggc

SEQ ID NO: 10486 - DNA, 19 bp, Artificial Sequence
  Description of Artificial Sequence: Chemically synthesized oligonucleotide
gcctgagaaggacaggtgt

SEQ ID NO: 10487 - DNA, 19 bp, Artificial Sequence
  Description of Artificial Sequence: Chemically synthesized oligonucleotide
cacctgtccttctcaggct

SEQ ID NO: 10488 - DNA, 19 bp, Artificial Sequence
  Description of Artificial Sequence: Chemically synthesized oligonucleotide
agcctgagaaggacaggtg

SEQ ID NO: 10489 - DNA, 19 bp, Artificial Sequence
  Description of Artificial Sequence: Chemically synthesized oligonucleotide
acctgtccttctcaggctg

SEQ ID NO: 10490 - DNA, 19 bp, Artificial Sequence
  Description of Artificial Sequence: Chemically synthesized oligonucleotide
cagcctgagaaggacaggt

SEQ ID NO: 10491 - DNA, 19 bp, Artificial Sequence
  Description of Artificial Sequence: Chemically synthesized oligonucleotide
cctgtccttctcaggctgg

SEQ ID NO: 10492 - DNA, 19 bp, Artificial Sequence
  Description of Artificial Sequence: Chemically synthesized oligonucleotide
ccagcctgagaaggacagg

SEQ ID NO: 10493 - DNA, 19 bp, Artificial Sequence
  Description of Artificial Sequence: Chemically synthesized oligonucleotide
ctgtccttctcaggctggc

SEQ ID NO: 10494 - DNA, 19 bp, Artificial Sequence
  Description of Artificial Sequence: Chemically synthesized oligonucleotide
gccagcctgagaaggacag

SEQ ID NO: 10495 - DNA, 19 bp, Artificial Sequence
  Description of Artificial Sequence: Chemically synthesized oligonucleotide
tgtccttctcaggctggca

SEQ ID NO: 10496 - DNA, 19 bp, Artificial Sequence
  Description of Artificial Sequence: Chemically synthesized oligonucleotide
tgccagcctgagaaggaca

SEQ ID NO: 10497 - DNA, 19 bp, Artificial Sequence
  Description of Artificial Sequence: Chemically synthesized oligonucleotide
gtccttctcaggctggcat

SEQ ID NO: 10498 - DNA, 19 bp, Artificial Sequence
  Description of Artificial Sequence: Chemically synthesized oligonucleotide
atgccagcctgagaaggac

SEQ ID NO: 10499 - DNA, 19 bp, Artificial Sequence
  Description of Artificial Sequence: Chemically synthesized oligonucleotide
tccttctcaggctggcatc

SEQ ID NO: 10500 - DNA, 19 bp, Artificial Sequence
  Description of Artificial Sequence: Chemically synthesized oligonucleotide
gatgccagcctgagaagga

SEQ ID NO: 10501 - DNA, 19 bp, Artificial Sequence
  Description of Artificial Sequence: Chemically synthesized oligonucleotide
ccttctcaggctggcatct

SEQ ID NO: 10502 - DNA, 19 bp, Artificial Sequence
  Description of Artificial Sequence: Chemically synthesized oligonucleotide
agatgccagcctgagaagg

SEQ ID NO: 10503 - DNA, 19 bp, Artificial Sequence
  Description of Artificial Sequence: Chemically synthesized oligonucleotide
cttctcaggctggcatctc

SEQ ID NO: 10504 - DNA, 19 bp, Artificial Sequence
  Description of Artificial Sequence: Chemically synthesized oligonucleotide
gagatgccagcctgagaag

SEQ ID NO: 10505 - DNA, 19 bp, Artificial Sequence
  Description of Artificial Sequence: Chemically synthesized oligonucleotide
ttctcaggctggcatctcc

SEQ ID NO: 10506 - DNA, 19 bp, Artificial Sequence
  Description of Artificial Sequence: Chemically synthesized oligonucleotide
ggagatgccagcctgagaa

SEQ ID NO: 10507 - DNA, 19 bp, Artificial Sequence
  Description of Artificial Sequence: Chemically synthesized oligonucleotide
tctcaggctggcatctccc

SEQ ID NO: 10508 - DNA, 19 bp, Artificial Sequence
  Description of Artificial Sequence: Chemically synthesized oligonucleotide
gggagatgccagcctgaga

SEQ ID NO: 10509 - DNA, 19 bp, Artificial Sequence
  Description of Artificial Sequence: Chemically synthesized oligonucleotide
ctcaggctggcatctcccc

SEQ ID NO: 10510 - DNA, 19 bp, Artificial Sequence
  Description of Artificial Sequence: Chemically synthesized oligonucleotide
ggggagatgccagcctgag

SEQ ID NO: 10511 - DNA, 19 bp, Artificial Sequence
  Description of Artificial Sequence: Chemically synthesized oligonucleotide
tcaggctggcatctccccc

SEQ ID NO: 10512 - DNA, 19 bp, Artificial Sequence
  Description of Artificial Sequence: Chemically synthesized oligonucleotide
gggggagatgccagcctga

SEQ ID NO: 10513 - DNA, 19 bp, Artificial Sequence
  Description of Artificial Sequence: Chemically synthesized oligonucleotide
caggctggcatctccccca

SEQ ID NO: 10514 - DNA, 19 bp, Artificial Sequence
  Description of Artificial Sequence: Chemically synthesized oligonucleotide
tgggggagatgccagcctg

SEQ ID NO: 10515 - DNA, 19 bp, Artificial Sequence
  Description of Artificial Sequence: Chemically synthesized oligonucleotide
aggctggcatctcccccac

SEQ ID NO: 10516 - DNA, 19 bp, Artificial Sequence
  Description of Artificial Sequence: Chemically synthesized oligonucleotide
gtgggggagatgccagcct

SEQ ID NO: 10517 - DNA, 19 bp, Artificial Sequence
  Description of Artificial Sequence: Chemically synthesized oligonucleotide
ggctggcatctcccccacc

SEQ ID NO: 10518 - DNA, 19 bp, Artificial Sequence
  Description of Artificial Sequence: Chemically synthesized oligonucleotide
ggtgggggagatgccagcc

SEQ ID NO: 10519 - DNA, 19 bp, Artificial Sequence
  Description of Artificial Sequence: Chemically synthesized oligonucleotide
gctggcatctcccccaccc

SEQ ID NO: 10520 - DNA, 19 bp, Artificial Sequence
  Description of Artificial Sequence: Chemically synthesized oligonucleotide
gggtgggggagatgccagc

SEQ ID NO: 10521 - DNA, 19 bp, Artificial Sequence
  Description of Artificial Sequence: Chemically synthesized oligonucleotide
ctggcatctcccccaccct

SEQ ID NO: 10522 - DNA, 19 bp, Artificial Sequence
  Description of Artificial Sequence: Chemically synthesized oligonucleotide
agggtgggggagatgccag

SEQ ID NO: 10523 - DNA, 19 bp, Artificial Sequence
  Description of Artificial Sequence: Chemically synthesized oligonucleotide
tggcatctcccccaccctg

SEQ ID NO: 10524 - DNA, 19 bp, Artificial Sequence
  Description of Artificial Sequence: Chemically synthesized oligonucleotide
cagggtgggggagatgcca

SEQ ID NO: 10525 - DNA, 19 bp, Artificial Sequence
  Description of Artificial Sequence: Chemically synthesized oligonucleotide
ggcatctcccccaccctgt

SEQ ID NO: 10526 - DNA, 19 bp, Artificial Sequence
  Description of Artificial Sequence: Chemically synthesized oligonucleotide
acagggtgggggagatgcc

SEQ ID NO: 10527 - DNA, 19 bp, Artificial Sequence
  Description of Artificial Sequence: Chemically synthesized oligonucleotide
gcatctcccccaccctgtg

SEQ ID NO: 10528 - DNA, 19 bp, Artificial Sequence
  Description of Artificial Sequence: Chemically synthesized oligonucleotide
cacagggtgggggagatgc

SEQ ID NO: 10529 - DNA, 19 bp, Artificial Sequence
  Description of Artificial Sequence: Chemically synthesized oligonucleotide
catctcccccaccctgtgc

SEQ ID NO: 10530 - DNA, 19 bp, Artificial Sequence
  Description of Artificial Sequence: Chemically synthesized oligonucleotide
gcacagggtgggggagatg

SEQ ID NO: 10531 - DNA, 19 bp, Artificial Sequence
  Description of Artificial Sequence: Chemically synthesized oligonucleotide
atctcccccaccctgtgcc

SEQ ID NO: 10532 - DNA, 19 bp, Artificial Sequence
  Description of Artificial Sequence: Chemically synthesized oligonucleotide
ggcacagggtgggggagat

SEQ ID NO: 10533 - DNA, 19 bp, Artificial Sequence
  Description of Artificial Sequence: Chemically synthesized oligonucleotide
tctcccccaccctgtgccc

SEQ ID NO: 10534 - DNA, 19 bp, Artificial Sequence
  Description of Artificial Sequence: Chemically synthesized oligonucleotide
gggcacagggtgggggaga

SEQ ID NO: 10535 - DNA, 19 bp, Artificial Sequence
  Description of Artificial Sequence: Chemically synthesized oligonucleotide
ctcccccaccctgtgcccc

SEQ ID NO: 10536 - DNA, 19 bp, Artificial Sequence
  Description of Artificial Sequence: Chemically synthesized oligonucleotide
ggggcacagggtgggggag

SEQ ID NO: 10537 - DNA, 19 bp, Artificial Sequence
  Description of Artificial Sequence: Chemically synthesized oligonucleotide
tcccccaccctgtgcccct

SEQ ID NO: 10538 - DNA, 19 bp, Artificial Sequence
  Description of Artificial Sequence: Chemically synthesized oligonucleotide
aggggcacagggtggggga

SEQ ID NO: 10539 - DNA, 19 bp, Artificial Sequence
  Description of Artificial Sequence: Chemically synthesized oligonucleotide
cccccaccctgtgcccctt

SEQ ID NO: 10540 - DNA, 19 bp, Artificial Sequence
  Description of Artificial Sequence: Chemically synthesized oligonucleotide
aaggggcacagggtggggg

SEQ ID NO: 10541 - DNA, 19 bp, Artificial Sequence
  Description of Artificial Sequence: Chemically synthesized oligonucleotide
ccccaccctgtgccccttt

SEQ ID NO: 10542 - DNA, 19 bp, Artificial Sequence
  Description of Artificial Sequence: Chemically synthesized oligonucleotide
aaaggggcacagggtgggg

SEQ ID NO: 10543 - DNA, 19 bp, Artificial Sequence
  Description of Artificial Sequence: Chemically synthesized oligonucleotide
cccaccctgtgcccctttt

SEQ ID NO: 10544 - DNA, 19 bp, Artificial Sequence
  Description of Artificial Sequence: Chemically synthesized oligonucleotide
aaaaggggcacagggtggg

SEQ ID NO: 10545 - DNA, 19 bp, Artificial Sequence
  Description of Artificial Sequence: Chemically synthesized oligonucleotide
ccaccctgtgccccttttc

SEQ ID NO: 10546 - DNA, 19 bp, Artificial Sequence
  Description of Artificial Sequence: Chemically synthesized oligonucleotide
gaaaaggggcacagggtgg

SEQ ID NO: 10547 - DNA, 19 bp, Artificial Sequence
  Description of Artificial Sequence: Chemically synthesized oligonucleotide
caccctgtgccccttttca

SEQ ID NO: 10548 - DNA, 19 bp, Artificial Sequence
  Description of Artificial Sequence: Chemically synthesized oligonucleotide
tgaaaaggggcacagggtg

SEQ ID NO: 10549 - DNA, 19 bp, Artificial Sequence
  Description of Artificial Sequence: Chemically synthesized oligonucleotide
accctgtgccccttttcat

SEQ ID NO: 10550 - DNA, 19 bp, Artificial Sequence
  Description of Artificial Sequence: Chemically synthesized oligonucleotide
atgaaaaggggcacagggt

SEQ ID NO: 10551 - DNA, 19 bp, Artificial Sequence
  Description of Artificial Sequence: Chemically synthesized oligonucleotide
ccctgtgccccttttcatg

SEQ ID NO: 10552 - DNA, 19 bp, Artificial Sequence
  Description of Artificial Sequence: Chemically synthesized oligonucleotide
catgaaaaggggcacaggg

SEQ ID NO: 10553 - DNA, 19 bp, Artificial Sequence
  Description of Artificial Sequence: Chemically synthesized oligonucleotide
cctgtgccccttttcatgg

SEQ ID NO: 10554 - DNA, 19 bp, Artificial Sequence
  Description of Artificial Sequence: Chemically synthesized oligonucleotide
ccatgaaaaggggcacagg

SEQ ID NO: 10555 - DNA, 19 bp, Artificial Sequence
  Description of Artificial Sequence: Chemically synthesized oligonucleotide
ctgtgccccttttcatggt

SEQ ID NO: 10556 - DNA, 19 bp, Artificial Sequence
  Description of Artificial Sequence: Chemically synthesized oligonucleotide
accatgaaaaggggcacag

SEQ ID NO: 10557 - DNA, 19 bp, Artificial Sequence
  Description of Artificial Sequence: Chemically synthesized oligonucleotide
tgtgccccttttcatggta

SEQ ID NO: 10558 - DNA, 19 bp, Artificial Sequence
  Description of Artificial Sequence: Chemically synthesized oligonucleotide
taccatgaaaaggggcaca

SEQ ID NO: 10559 - DNA, 19 bp, Artificial Sequence
  Description of Artificial Sequence: Chemically synthesized oligonucleotide
gtgccccttttcatggtac

SEQ ID NO: 10560 - DNA, 19 bp, Artificial Sequence
  Description of Artificial Sequence: Chemically synthesized oligonucleotide
gtaccatgaaaaggggcac

SEQ ID NO: 10561 - DNA, 19 bp, Artificial Sequence
  Description of Artificial Sequence: Chemically synthesized oligonucleotide
tgccccttttcatggtacc

SEQ ID NO: 10562 - DNA, 19 bp, Artificial Sequence
  Description of Artificial Sequence: Chemically synthesized oligonucleotide
ggtaccatgaaaaggggca

SEQ ID NO: 10563 - DNA, 19 bp, Artificial Sequence
  Description of Artificial Sequence: Chemically synthesized oligonucleotide
gccccttttcatggtacca

SEQ ID NO: 10564 - DNA, 19 bp, Artificial Sequence
  Description of Artificial Sequence: Chemically synthesized oligonucleotide
tggtaccatgaaaaggggc

SEQ ID NO: 10565 - DNA, 19 bp, Artificial Sequence
  Description of Artificial Sequence: Chemically synthesized oligonucleotide
ccccttttcatggtaccag

SEQ ID NO: 10566 - DNA, 19 bp, Artificial Sequence
  Description of Artificial Sequence: Chemically synthesized oligonucleotide
ctggtaccatgaaaagggg

SEQ ID NO: 10567 - DNA, 19 bp, Artificial Sequence
  Description of Artificial Sequence: Chemically synthesized oligonucleotide
cccttttcatggtaccagg

SEQ ID NO: 10568 - DNA, 19 bp, Artificial Sequence
  Description of Artificial Sequence: Chemically synthesized oligonucleotide
cctggtaccatgaaaaggg

SEQ ID NO: 10569 - DNA, 19 bp, Artificial Sequence
  Description of Artificial Sequence: Chemically synthesized oligonucleotide
ccttttcatggtaccaggc

SEQ ID NO: 10570 - DNA, 19 bp, Artificial Sequence
  Description of Artificial Sequence: Chemically synthesized oligonucleotide
gcctggtaccatgaaaagg

SEQ ID NO: 10571 - DNA, 19 bp, Artificial Sequence
  Description of Artificial Sequence: Chemically synthesized oligonucleotide
cttttcatggtaccaggcc

SEQ ID NO: 10572 - DNA, 19 bp, Artificial Sequence
  Description of Artificial Sequence: Chemically synthesized oligonucleotide
ggcctggtaccatgaaaag

SEQ ID NO: 10573 - DNA, 19 bp, Artificial Sequence
  Description of Artificial Sequence: Chemically synthesized oligonucleotide
ttttcatggtaccaggccc

SEQ ID NO: 10574 - DNA, 19 bp, Artificial Sequence
  Description of Artificial Sequence: Chemically synthesized oligonucleotide
gggcctggtaccatgaaaa

SEQ ID NO: 10575 - DNA, 19 bp, Artificial Sequence
  Description of Artificial Sequence: Chemically synthesized oligonucleotide
tttcatggtaccaggcccg

SEQ ID NO: 10576 - DNA, 19 bp, Artificial Sequence
  Description of Artificial Sequence: Chemically synthesized oligonucleotide
cgggcctggtaccatgaaa

SEQ ID NO: 10577 - DNA, 19 bp, Artificial Sequence
  Description of Artificial Sequence: Chemically synthesized oligonucleotide
ttcatggtaccaggcccgc

SEQ ID NO: 10578 - DNA, 19 bp, Artificial Sequence
  Description of Artificial Sequence: Chemically synthesized oligonucleotide
gcgggcctggtaccatgaa

SEQ ID NO: 10579 - DNA, 19 bp, Artificial Sequence
  Description of Artificial Sequence: Chemically synthesized oligonucleotide
tcatggtaccaggcccgca

SEQ ID NO: 10580 - DNA, 19 bp, Artificial Sequence
  Description of Artificial Sequence: Chemically synthesized oligonucleotide
tgcgggcctggtaccatga

SEQ ID NO: 10581 - DNA, 19 bp, Artificial Sequence
  Description of Artificial Sequence: Chemically synthesized oligonucleotide
catggtaccaggcccgcac

SEQ ID NO: 10582 - DNA, 19 bp, Artificial Sequence
  Description of Artificial Sequence: Chemically synthesized oligonucleotide
gtgcgggcctggtaccatg

SEQ ID NO: 10583 - DNA, 19 bp, Artificial Sequence
  Description of Artificial Sequence: Chemically synthesized oligonucleotide
atggtaccaggcccgcact

SEQ ID NO: 10584 - DNA, 19 bp, Artificial Sequence
  Description of Artificial Sequence: Chemically synthesized oligonucleotide
agtgcgggcctggtaccat

SEQ ID NO: 10585 - DNA, 19 bp, Artificial Sequence
  Description of Artificial Sequence: Chemically synthesized oligonucleotide
tggtaccaggcccgcactg

SEQ ID NO: 10586 - DNA, 19 bp, Artificial Sequence
  Description of Artificial Sequence: Chemically synthesized oligonucleotide
cagtgcgggcctggtacca

SEQ ID NO: 10587 - DNA, 19 bp, Artificial Sequence
  Description of Artificial Sequence: Chemically synthesized oligonucleotide
ggtaccaggcccgcactgg

SEQ ID NO: 10588 - DNA, 19 bp, Artificial Sequence
  Description of Artificial Sequence: Chemically synthesized oligonucleotide
ccagtgcgggcctggtacc

SEQ ID NO: 10589 - DNA, 19 bp, Artificial Sequence
  Description of Artificial Sequence: Chemically synthesized oligonucleotide
gtaccaggcccgcactggg

SEQ ID NO: 10590 - DNA, 19 bp, Artificial Sequence
  Description of Artificial Sequence: Chemically synthesized oligonucleotide
cccagtgcgggcctggtac

SEQ ID NO: 10591 - DNA, 19 bp, Artificial Sequence
  Description of Artificial Sequence: Chemically synthesized oligonucleotide
taccaggcccgcactgggg

SEQ ID NO: 10592 - DNA, 19 bp, Artificial Sequence
  Description of Artificial Sequence: Chemically synthesized oligonucleotide
ccccagtgcgggcctggta

SEQ ID NO: 10593 - DNA, 19 bp, Artificial Sequence
  Description of Artificial Sequence: Chemically synthesized oligonucleotide
accaggcccgcactggggg

SEQ ID NO: 10594 - DNA, 19 bp, Artificial Sequence
  Description of Artificial Sequence: Chemically synthesized oligonucleotide
cccccagtgcgggcctggt

SEQ ID NO: 10595 - DNA, 19 bp, Artificial Sequence
  Description of Artificial Sequence: Chemically synthesized oligonucleotide
ccaggcccgcactgggggc

SEQ ID NO: 10596 - DNA, 19 bp, Artificial Sequence
  Description of Artificial Sequence: Chemically synthesized oligonucleotide
gcccccagtgcgggcctgg

SEQ ID NO: 10597 - DNA, 19 bp, Artificial Sequence
  Description of Artificial Sequence: Chemically synthesized oligonucleotide
caggcccgcactgggggca

SEQ ID NO: 10598 - DNA, 19 bp, Artificial Sequence
  Description of Artificial Sequence: Chemically synthesized oligonucleotide
tgcccccagtgcgggcctg

SEQ ID NO: 10599 - DNA, 19 bp, Artificial Sequence
  Description of Artificial Sequence: Chemically synthesized oligonucleotide
aggcccgcactgggggcaa

SEQ ID NO: 10600 - DNA, 19 bp, Artificial Sequence
  Description of Artificial Sequence: Chemically synthesized oligonucleotide
ttgcccccagtgcgggcct

SEQ ID NO: 10601 - DNA, 19 bp, Artificial Sequence
  Description of Artificial Sequence: Chemically synthesized oligonucleotide
ggcccgcactgggggcaat

SEQ ID NO: 10602 - DNA, 19 bp, Artificial Sequence
  Description of Artificial Sequence: Chemically synthesized oligonucleotide
attgcccccagtgcgggcc

SEQ ID NO: 10603 - DNA, 19 bp, Artificial Sequence
  Description of Artificial Sequence: Chemically synthesized oligonucleotide
gcccgcactgggggcaatt

SEQ ID NO: 10604 - DNA, 19 bp, Artificial Sequence
  Description of Artificial Sequence: Chemically synthesized oligonucleotide
aattgcccccagtgcgggc

SEQ ID NO: 10605 - DNA, 19 bp, Artificial Sequence
  Description of Artificial Sequence: Chemically synthesized oligonucleotide
cccgcactgggggcaattg

SEQ ID NO: 10606 - DNA, 19 bp, Artificial Sequence
  Description of Artificial Sequence: Chemically synthesized oligonucleotide
caattgcccccagtgcggg

SEQ ID NO: 10607 - DNA, 19 bp, Artificial Sequence
  Description of Artificial Sequence: Chemically synthesized oligonucleotide
ccgcactgggggcaattga

SEQ ID NO: 10608 - DNA, 19 bp, Artificial Sequence
  Description of Artificial Sequence: Chemically synthesized oligonucleotide
tcaattgcccccagtgcgg

SEQ ID NO: 10609 - DNA, 19 bp, Artificial Sequence
  Description of Artificial Sequence: Chemically synthesized oligonucleotide
cgcactgggggcaattgac

SEQ ID NO: 10610 - DNA, 19 bp, Artificial Sequence
  Description of Artificial Sequence: Chemically synthesized oligonucleotide
gtcaattgcccccagtgcg

SEQ ID NO: 10611 - DNA, 19 bp, Artificial Sequence
  Description of Artificial Sequence: Chemically synthesized oligonucleotide
gcactgggggcaattgact

SEQ ID NO: 10612 - DNA, 19 bp, Artificial Sequence
  Description of Artificial Sequence: Chemically synthesized oligonucleotide
agtcaattgcccccagtgc

SEQ ID NO: 10613 - DNA, 19 bp, Artificial Sequence
  Description of Artificial Sequence: Chemically synthesized oligonucleotide
cactgggggcaattgactt

SEQ ID NO: 10614 - DNA, 19 bp, Artificial Sequence
  Description of Artificial Sequence: Chemically synthesized oligonucleotide
aagtcaattgcccccagtg

SEQ ID NO: 10615 - DNA, 19 bp, Artificial Sequence
  Description of Artificial Sequence: Chemically synthesized oligonucleotide
actgggggcaattgacttc

SEQ ID NO: 10616 - DNA, 19 bp, Artificial Sequence
  Description of Artificial Sequence: Chemically synthesized oligonucleotide
gaagtcaattgcccccagt

SEQ ID NO: 10617 - DNA, 19 bp, Artificial Sequence
  Description of Artificial Sequence: Chemically synthesized oligonucleotide
ctgggggcaattgacttcc

SEQ ID NO: 10618 - DNA, 19 bp, Artificial Sequence
  Description of Artificial Sequence: Chemically synthesized oligonucleotide
ggaagtcaattgcccccag

SEQ ID NO: 10619 - DNA, 19 bp, Artificial Sequence
  Description of Artificial Sequence: Chemically synthesized oligonucleotide
tgggggcaattgacttcct

SEQ ID NO: 10620 - DNA, 19 bp, Artificial Sequence
  Description of Artificial Sequence: Chemically synthesized oligonucleotide
aggaagtcaattgccccca

SEQ ID NO: 10621 - DNA, 19 bp, Artificial Sequence
  Description of Artificial Sequence: Chemically synthesized oligonucleotide
gggggcaattgacttcctc

SEQ ID NO: 10622 - DNA, 19 bp, Artificial Sequence
  Description of Artificial Sequence: Chemically synthesized oligonucleotide
gaggaagtcaattgccccc

SEQ ID NO: 10623 - DNA, 19 bp, Artificial Sequence
  Description of Artificial Sequence: Chemically synthesized oligonucleotide
ggggcaattgacttcctcc

SEQ ID NO: 10624 - DNA, 19 bp, Artificial Sequence
  Description of Artificial Sequence: Chemically synthesized oligonucleotide
ggaggaagtcaattgcccc

SEQ ID NO: 10625 - DNA, 19 bp, Artificial Sequence
  Description of Artificial Sequence: Chemically synthesized oligonucleotide
gggcaattgacttcctcca

SEQ ID NO: 10626 - DNA, 19 bp, Artificial Sequence
  Description of Artificial Sequence: Chemically synthesized oligonucleotide
tggaggaagtcaattgccc

SEQ ID NO: 10627 - DNA, 19 bp, Artificial Sequence
  Description of Artificial Sequence: Chemically synthesized oligonucleotide
ggcaattgacttcctccaa

SEQ ID NO: 10628 - DNA, 19 bp, Artificial Sequence
  Description of Artificial Sequence: Chemically synthesized oligonucleotide
ttggaggaagtcaattgcc

SEQ ID NO: 10629 - DNA, 19 bp, Artificial Sequence
  Description of Artificial Sequence: Chemically synthesized oligonucleotide
gcaattgacttcctccaat

SEQ ID NO: 10630 - DNA, 19 bp, Artificial Sequence
  Description of Artificial Sequence: Chemically synthesized oligonucleotide
attggaggaagtcaattgc

SEQ ID NO: 10631 - DNA, 19 bp, Artificial Sequence
  Description of Artificial Sequence: Chemically synthesized oligonucleotide
caattgacttcctccaatc

SEQ ID NO: 10632 - DNA, 19 bp, Artificial Sequence
  Description of Artificial Sequence: Chemically synthesized oligonucleotide
gattggaggaagtcaattg

SEQ ID NO: 10633 - DNA, 19 bp, Artificial Sequence
  Description of Artificial Sequence: Chemically synthesized oligonucleotide
aattgacttcctccaatcc

SEQ ID NO: 10634 - DNA, 19 bp, Artificial Sequence
  Description of Artificial Sequence: Chemically synthesized oligonucleotide
ggattggaggaagtcaatt

SEQ ID NO: 10635 - DNA, 19 bp, Artificial Sequence
  Description of Artificial Sequence: Chemically synthesized oligonucleotide
attgacttcctccaatccc

SEQ ID NO: 10636 - DNA, 19 bp, Artificial Sequence
  Description of Artificial Sequence: Chemically synthesized oligonucleotide
gggattggaggaagtcaat

SEQ ID NO: 10637 - DNA, 19 bp, Artificial Sequence
  Description of Artificial Sequence: Chemically synthesized oligonucleotide
ttgacttcctccaatcccc

SEQ ID NO: 10638 - DNA, 19 bp, Artificial Sequence
  Description of Artificial Sequence: Chemically synthesized oligonucleotide
ggggattggaggaagtcaa

SEQ ID NO: 10639 - DNA, 19 bp, Artificial Sequence
  Description of Artificial Sequence: Chemically synthesized oligonucleotide
tgacttcctccaatcccca

SEQ ID NO: 10640 - DNA, 19 bp, Artificial Sequence
  Description of Artificial Sequence: Chemically synthesized oligonucleotide
tggggattggaggaagtca

SEQ ID NO: 10641 - DNA, 19 bp, Artificial Sequence
  Description of Artificial Sequence: Chemically synthesized oligonucleotide
gacttcctccaatccccac

SEQ ID NO: 10642 - DNA, 19 bp, Artificial Sequence
  Description of Artificial Sequence: Chemically synthesized oligonucleotide
gtggggattggaggaagtc

SEQ ID NO: 10643 - DNA, 19 bp, Artificial Sequence
  Description of Artificial Sequence: Chemically synthesized oligonucleotide
acttcctccaatccccact

SEQ ID NO: 10644 - DNA, 19 bp, Artificial Sequence
  Description of Artificial Sequence: Chemically synthesized oligonucleotide
agtggggattggaggaagt

SEQ ID NO: 10645 - DNA, 19 bp, Artificial Sequence
  Description of Artificial Sequence: Chemically synthesized oligonucleotide
cttcctccaatccccactc

SEQ ID NO: 10646 - DNA, 19 bp, Artificial Sequence
  Description of Artificial Sequence: Chemically synthesized oligonucleotide
gagtggggattggaggaag

SEQ ID NO: 10647 - DNA, 19 bp, Artificial Sequence
  Description of Artificial Sequence: Chemically synthesized oligonucleotide
ttcctccaatccccactcc

SEQ ID NO: 10648 - DNA, 19 bp, Artificial Sequence
  Description of Artificial Sequence: Chemically synthesized oligonucleotide
ggagtggggattggaggaa

SEQ ID NO: 10649 - DNA, 19 bp, Artificial Sequence
  Description of Artificial Sequence: Chemically synthesized oligonucleotide
tcctccaatccccactcct

SEQ ID NO: 10650 - DNA, 19 bp, Artificial Sequence
  Description of Artificial Sequence: Chemically synthesized oligonucleotide
aggagtggggattggagga

SEQ ID NO: 10651 - DNA, 19 bp, Artificial Sequence
  Description of Artificial Sequence: Chemically synthesized oligonucleotide
cctccaatccccactcctc

SEQ ID NO: 10652 - DNA, 19 bp, Artificial Sequence
  Description of Artificial Sequence: Chemically synthesized oligonucleotide
gaggagtggggattggagg

SEQ ID NO: 10653 - DNA, 19 bp, Artificial Sequence
  Description of Artificial Sequence: Chemically synthesized oligonucleotide
ctccaatccccactcctcc

SEQ ID NO: 10654 - DNA, 19 bp, Artificial Sequence
  Description of Artificial Sequence: Chemically synthesized oligonucleotide
ggaggagtggggattggag

SEQ ID NO: 10655 - DNA, 19 bp, Artificial Sequence
  Description of Artificial Sequence: Chemically synthesized oligonucleotide
tccaatccccactcctccg

SEQ ID NO: 10656 - DNA, 19 bp, Artificial Sequence
  Description of Artificial Sequence: Chemically synthesized oligonucleotide
cggaggagtggggattgga

SEQ ID NO: 10657 - DNA, 19 bp, Artificial Sequence
  Description of Artificial Sequence: Chemically synthesized oligonucleotide
ccaatccccactcctccga

SEQ ID NO: 10658 - DNA, 19 bp, Artificial Sequence
  Description of Artificial Sequence: Chemically synthesized oligonucleotide
tcggaggagtggggattgg

SEQ ID NO: 10659 - DNA, 19 bp, Artificial Sequence
  Description of Artificial Sequence: Chemically synthesized oligonucleotide
caatccccactcctccgag

SEQ ID NO: 10660 - DNA, 19 bp, Artificial Sequence
  Description of Artificial Sequence: Chemically synthesized oligonucleotide
ctcggaggagtggggattg

SEQ ID NO: 10661 - DNA, 19 bp, Artificial Sequence
  Description of Artificial Sequence: Chemically synthesized oligonucleotide
aatccccactcctccgaga

SEQ ID NO: 10662 - DNA, 19 bp, Artificial Sequence
  Description of Artificial Sequence: Chemically synthesized oligonucleotide
tctcggaggagtggggatt

SEQ ID NO: 10663 - DNA, 19 bp, Artificial Sequence
  Description of Artificial Sequence: Chemically synthesized oligonucleotide
atccccactcctccgagac

SEQ ID NO: 10664 - DNA, 19 bp, Artificial Sequence
  Description of Artificial Sequence: Chemically synthesized oligonucleotide
gtctcggaggagtggggat

SEQ ID NO: 10665 - DNA, 19 bp, Artificial Sequence
  Description of Artificial Sequence: Chemically synthesized oligonucleotide
tccccactcctccgagacc

SEQ ID NO: 10666 - DNA, 19 bp, Artificial Sequence
  Description of Artificial Sequence: Chemically synthesized oligonucleotide
ggtctcggaggagtgggga

SEQ ID NO: 10667 - DNA, 19 bp, Artificial Sequence
  Description of Artificial Sequence: Chemically synthesized oligonucleotide
ccccactcctccgagaccc

SEQ ID NO: 10668 - DNA, 19 bp, Artificial Sequence
  Description of Artificial Sequence: Chemically synthesized oligonucleotide
gggtctcggaggagtgggg

SEQ ID NO: 10669 - DNA, 19 bp, Artificial Sequence
  Description of Artificial Sequence: Chemically synthesized oligonucleotide
cccactcctccgagaccca

SEQ ID NO: 10670 - DNA, 19 bp, Artificial Sequence
  Description of Artificial Sequence: Chemically synthesized oligonucleotide
tgggtctcggaggagtggg

SEQ ID NO: 10671 - DNA, 19 bp, Artificial Sequence
  Description of Artificial Sequence: Chemically synthesized oligonucleotide
ccactcctccgagacccag

SEQ ID NO: 10672 - DNA, 19 bp, Artificial Sequence
  Description of Artificial Sequence: Chemically synthesized oligonucleotide
ctgggtctcggaggagtgg

SEQ ID NO: 10673 - DNA, 19 bp, Artificial Sequence
  Description of Artificial Sequence: Chemically synthesized oligonucleotide
cactcctccgagacccagg

SEQ ID NO: 10674 - DNA, 19 bp, Artificial Sequence
  Description of Artificial Sequence: Chemically synthesized oligonucleotide
cctgggtctcggaggagtg

SEQ ID NO: 10675 - DNA, 19 bp, Artificial Sequence
  Description of Artificial Sequence: Chemically synthesized oligonucleotide
actcctccgagacccagga

SEQ ID NO: 10676 - DNA, 19 bp, Artificial Sequence
  Description of Artificial Sequence: Chemically synthesized oligonucleotide
tcctgggtctcggaggagt

SEQ ID NO: 10677 - DNA, 19 bp, Artificial Sequence
  Description of Artificial Sequence: Chemically synthesized oligonucleotide
ctcctccgagacccaggag

SEQ ID NO: 10678 - DNA, 19 bp, Artificial Sequence
  Description of Artificial Sequence: Chemically synthesized oligonucleotide
ctcctgggtctcggaggag

SEQ ID NO: 10679 - DNA, 19 bp, Artificial Sequence
  Description of Artificial Sequence: Chemically synthesized oligonucleotide
tcctccgagacccaggaga

SEQ ID NO: 10680 - DNA, 19 bp, Artificial Sequence
  Description of Artificial Sequence: Chemically synthesized oligonucleotide
tctcctgggtctcggagga

SEQ ID NO: 10681 - DNA, 19 bp, Artificial Sequence
  Description of Artificial Sequence: Chemically synthesized oligonucleotide
cctccgagacccaggagac

SEQ ID NO: 10682 - DNA, 19 bp, Artificial Sequence
  Description of Artificial Sequence: Chemically synthesized oligonucleotide
gtctcctgggtctcggagg

SEQ ID NO: 10683 - DNA, 19 bp, Artificial Sequence
  Description of Artificial Sequence: Chemically synthesized oligonucleotide
ctccgagacccaggagaca

SEQ ID NO: 10684 - DNA, 19 bp, Artificial Sequence
  Description of Artificial Sequence: Chemically synthesized oligonucleotide
tgtctcctgggtctcggag

SEQ ID NO: 10685 - DNA, 19 bp, Artificial Sequence
  Description of Artificial Sequence: Chemically synthesized oligonucleotide
tccgagacccaggagacaa

SEQ ID NO: 10686 - DNA, 19 bp, Artificial Sequence
  Description of Artificial Sequence: Chemically synthesized oligonucleotide
ttgtctcctgggtctcgga

SEQ ID NO: 10687 - DNA, 19 bp, Artificial Sequence
  Description of Artificial Sequence: Chemically synthesized oligonucleotide
ccgagacccaggagacaaa

SEQ ID NO: 10688 - DNA, 19 bp, Artificial Sequence
  Description of Artificial Sequence: Chemically synthesized oligonucleotide
tttgtctcctgggtctcgg

SEQ ID NO: 10689 - DNA, 19 bp, Artificial Sequence
  Description of Artificial Sequence: Chemically synthesized oligonucleotide
cgagacccaggagacaaac

SEQ ID NO: 10690 - DNA, 19 bp, Artificial Sequence
  Description of Artificial Sequence: Chemically synthesized oligonucleotide
gtttgtctcctgggtctcg

SEQ ID NO: 10691 - DNA, 19 bp, Artificial Sequence
  Description of Artificial Sequence: Chemically synthesized oligonucleotide
gagacccaggagacaaaca

SEQ ID NO: 10692 - DNA, 19 bp, Artificial Sequence
  Description of Artificial Sequence: Chemically synthesized oligonucleotide
tgtttgtctcctgggtctc

SEQ ID NO: 10693 - DNA, 19 bp, Artificial Sequence
  Description of Artificial Sequence: Chemically synthesized oligonucleotide
agacccaggagacaaacag

SEQ ID NO: 10694 - DNA, 19 bp, Artificial Sequence
  Description of Artificial Sequence: Chemically synthesized oligonucleotide
ctgtttgtctcctgggtct

SEQ ID NO: 10695 - DNA, 19 bp, Artificial Sequence
  Description of Artificial Sequence: Chemically synthesized oligonucleotide
gacccaggagacaaacagc

SEQ ID NO: 10696 - DNA, 19 bp, Artificial Sequence
  Description of Artificial Sequence: Chemically synthesized oligonucleotide
gctgtttgtctcctgggtc

SEQ ID NO: 10697 - DNA, 19 bp, Artificial Sequence
  Description of Artificial Sequence: Chemically synthesized oligonucleotide
acccaggagacaaacagcc

SEQ ID NO: 10698 - DNA, 19 bp, Artificial Sequence
  Description of Artificial Sequence: Chemically synthesized oligonucleotide
ggctgtttgtctcctgggt

SEQ ID NO: 10699 - DNA, 19 bp, Artificial Sequence
  Description of Artificial Sequence: Chemically synthesized oligonucleotide
cccaggagacaaacagccc

SEQ ID NO: 10700 - DNA, 19 bp, Artificial Sequence
  Description of Artificial Sequence: Chemically synthesized oligonucleotide
gggctgtttgtctcctggg

SEQ ID NO: 10701 - DNA, 19 bp, Artificial Sequence
  Description of Artificial Sequence: Chemically synthesized oligonucleotide
ccaggagacaaacagccct

SEQ ID NO: 10702 - DNA, 19 bp, Artificial Sequence
  Description of Artificial Sequence: Chemically synthesized oligonucleotide
agggctgtttgtctcctgg

SEQ ID NO: 10703 - DNA, 19 bp, Artificial Sequence
  Description of Artificial Sequence: Chemically synthesized oligonucleotide
caggagacaaacagccctt

SEQ ID NO: 10704 - DNA, 19 bp, Artificial Sequence
  Description of Artificial Sequence: Chemically synthesized oligonucleotide
aagggctgtttgtctcctg

SEQ ID NO: 10705 - DNA, 19 bp, Artificial Sequence
  Description of Artificial Sequence: Chemically synthesized oligonucleotide
aggagacaaacagcccttc

SEQ ID NO: 10706 - DNA, 19 bp, Artificial Sequence
  Description of Artificial Sequence: Chemically synthesized oligonucleotide
gaagggctgtttgtctcct

SEQ ID NO: 10707 - DNA, 19 bp, Artificial Sequence
  Description of Artificial Sequence: Chemically synthesized oligonucleotide
ggagacaaacagcccttcc

SEQ ID NO: 10708 - DNA, 19 bp, Artificial Sequence
  Description of Artificial Sequence: Chemically synthesized oligonucleotide
ggaagggctgtttgtctcc

SEQ ID NO: 10709 - DNA, 19 bp, Artificial Sequence
  Description of Artificial Sequence: Chemically synthesized oligonucleotide
gagacaaacagcccttcct

SEQ ID NO: 10710 - DNA, 19 bp, Artificial Sequence
  Description of Artificial Sequence: Chemically synthesized oligonucleotide
aggaagggctgtttgtctc

SEQ ID NO: 10711 - DNA, 19 bp, Artificial Sequence
  Description of Artificial Sequence: Chemically synthesized oligonucleotide
agacaaacagcccttcctt

SEQ ID NO: 10712 - DNA, 19 bp, Artificial Sequence
  Description of Artificial Sequence: Chemically synthesized oligonucleotide
aaggaagggctgtttgtct

SEQ ID NO: 10713 - DNA, 19 bp, Artificial Sequence
  Description of Artificial Sequence: Chemically synthesized oligonucleotide
gacaaacagcccttccttg

SEQ ID NO: 10714 - DNA, 19 bp, Artificial Sequence
  Description of Artificial Sequence: Chemically synthesized oligonucleotide
caaggaagggctgtttgtc

SEQ ID NO: 10715 - DNA, 19 bp, Artificial Sequence
  Description of Artificial Sequence: Chemically synthesized oligonucleotide
acaaacagcccttccttgg

SEQ ID NO: 10716 - DNA, 19 bp, Artificial Sequence
  Description of Artificial Sequence: Chemically synthesized oligonucleotide
ccaaggaagggctgtttgt

SEQ ID NO: 10717 - DNA, 19 bp, Artificial Sequence
  Description of Artificial Sequence: Chemically synthesized oligonucleotide
caaacagcccttccttggg

SEQ ID NO: 10718 - DNA, 19 bp, Artificial Sequence
  Description of Artificial Sequence: Chemically synthesized oligonucleotide
cccaaggaagggctgtttg

SEQ ID NO: 10719 - DNA, 19 bp, Artificial Sequence
  Description of Artificial Sequence: Chemically synthesized oligonucleotide
aaacagcccttccttgggg

SEQ ID NO: 10720 - DNA, 19 bp, Artificial Sequence
  Description of Artificial Sequence: Chemically synthesized oligonucleotide
ccccaaggaagggctgttt

SEQ ID NO: 10721 - DNA, 19 bp, Artificial Sequence
  Description of Artificial Sequence: Chemically synthesized oligonucleotide
aacagcccttccttgggga

SEQ ID NO: 10722 - DNA, 19 bp, Artificial Sequence
  Description of Artificial Sequence: Chemically synthesized oligonucleotide
tccccaaggaagggctgtt

SEQ ID NO: 10723 - DNA, 19 bp, Artificial Sequence
  Description of Artificial Sequence: Chemically synthesized oligonucleotide
acagcccttccttggggaa

SEQ ID NO: 10724 - DNA, 19 bp, Artificial Sequence
  Description of Artificial Sequence: Chemically synthesized oligonucleotide
ttccccaaggaagggctgt

SEQ ID NO: 10725 - DNA, 19 bp, Artificial Sequence
  Description of Artificial Sequence: Chemically synthesized oligonucleotide
cagcccttccttggggaaa

SEQ ID NO: 10726 - DNA, 19 bp, Artificial Sequence
  Description of Artificial Sequence: Chemically synthesized oligonucleotide
tttccccaaggaagggctg

SEQ ID NO: 10727 - DNA, 19 bp, Artificial Sequence
  Description of Artificial Sequence: Chemically synthesized oligonucleotide
agcccttccttggggaaac

SEQ ID NO: 10728 - DNA, 19 bp, Artificial Sequence
  Description of Artificial Sequence: Chemically synthesized oligonucleotide
gtttccccaaggaagggct

SEQ ID NO: 10729 - DNA, 19 bp, Artificial Sequence
  Description of Artificial Sequence: Chemically synthesized oligonucleotide
gcccttccttggggaaact

SEQ ID NO: 10730 - DNA, 19 bp, Artificial Sequence
  Description of Artificial Sequence: Chemically synthesized oligonucleotide
agtttccccaaggaagggc

SEQ ID NO: 10731 - DNA, 19 bp, Artificial Sequence
  Description of Artificial Sequence: Chemically synthesized oligonucleotide
cccttccttggggaaactt

SEQ ID NO: 10732 - DNA, 19 bp, Artificial Sequence
  Description of Artificial Sequence: Chemically synthesized oligonucleotide
aagtttccccaaggaaggg

SEQ ID NO: 10733 - DNA, 19 bp, Artificial Sequence
  Description of Artificial Sequence: Chemically synthesized oligonucleotide
ccttccttggggaaacttg

SEQ ID NO: 10734 - DNA, 19 bp, Artificial Sequence
  Description of Artificial Sequence: Chemically synthesized oligonucleotide
caagtttccccaaggaagg

SEQ ID NO: 10735 - DNA, 19 bp, Artificial Sequence
  Description of Artificial Sequence: Chemically synthesized oligonucleotide
cttccttggggaaacttgg

SEQ ID NO: 10736 - DNA, 19 bp, Artificial Sequence
  Description of Artificial Sequence: Chemically synthesized oligonucleotide
ccaagtttccccaaggaag

SEQ ID NO: 10737 - DNA, 19 bp, Artificial Sequence
  Description of Artificial Sequence: Chemically synthesized oligonucleotide
ttccttggggaaacttggg

SEQ ID NO: 10738 - DNA, 19 bp, Artificial Sequence
  Description of Artificial Sequence: Chemically synthesized oligonucleotide
cccaagtttccccaaggaa

SEQ ID NO: 10739 - DNA, 19 bp, Artificial Sequence
  Description of Artificial Sequence: Chemically synthesized oligonucleotide
tccttggggaaacttggga

SEQ ID NO: 10740 - DNA, 19 bp, Artificial Sequence
  Description of Artificial Sequence: Chemically synthesized oligonucleotide
tcccaagtttccccaagga

SEQ ID NO: 10741 - DNA, 19 bp, Artificial Sequence
  Description of Artificial Sequence: Chemically synthesized oligonucleotide
ccttggggaaacttgggaa

SEQ ID NO: 10742 - DNA, 19 bp, Artificial Sequence
  Description of Artificial Sequence: Chemically synthesized oligonucleotide
ttcccaagtttccccaagg

SEQ ID NO: 10743 - DNA, 19 bp, Artificial Sequence
  Description of Artificial Sequence: Chemically synthesized oligonucleotide
cttggggaaacttgggaat

SEQ ID NO: 10744 - DNA, 19 bp, Artificial Sequence
  Description of Artificial Sequence: Chemically synthesized oligonucleotide
attcccaagtttccccaag

SEQ ID NO: 10745 - DNA, 19 bp, Artificial Sequence
  Description of Artificial Sequence: Chemically synthesized oligonucleotide
ttggggaaacttgggaatc

SEQ ID NO: 10746 - DNA, 19 bp, Artificial Sequence
  Description of Artificial Sequence: Chemically synthesized oligonucleotide
gattcccaagtttccccaa

SEQ ID NO: 10747 - DNA, 19 bp, Artificial Sequence
  Description of Artificial Sequence: Chemically synthesized oligonucleotide
tggggaaacttgggaatca

SEQ ID NO: 10748 - DNA, 19 bp, Artificial Sequence
  Description of Artificial Sequence: Chemically synthesized oligonucleotide
tgattcccaagtttcccca

SEQ ID NO: 10749 - DNA, 19 bp, Artificial Sequence
  Description of Artificial Sequence: Chemically synthesized oligonucleotide
ggggaaacttgggaatcat

SEQ ID NO: 10750 - DNA, 19 bp, Artificial Sequence
  Description of Artificial Sequence: Chemically synthesized oligonucleotide
atgattcccaagtttcccc

SEQ ID NO: 10751 - DNA, 19 bp, Artificial Sequence
  Description of Artificial Sequence: Chemically synthesized oligonucleotide
gggaaacttgggaatcatt

SEQ ID NO: 10752 - DNA, 19 bp, Artificial Sequence
  Description of Artificial Sequence: Chemically synthesized oligonucleotide
aatgattcccaagtttccc

SEQ ID NO: 10753 - DNA, 19 bp, Artificial Sequence
  Description of Artificial Sequence: Chemically synthesized oligonucleotide
ggaaacttgggaatcattc

SEQ ID NO: 10754 - DNA, 19 bp, Artificial Sequence
  Description of Artificial Sequence: Chemically synthesized oligonucleotide
gaatgattcccaagtttcc

SEQ ID NO: 10755 - DNA, 19 bp, Artificial Sequence
  Description of Artificial Sequence: Chemically synthesized oligonucleotide
gaaacttgggaatcattct

SEQ ID NO: 10756 - DNA, 19 bp, Artificial Sequence
  Description of Artificial Sequence: Chemically synthesized oligonucleotide
agaatgattcccaagtttc

SEQ ID NO: 10757 - DNA, 19 bp, Artificial Sequence
  Description of Artificial Sequence: Chemically synthesized oligonucleotide
aaacttgggaatcattctg

SEQ ID NO: 10758 - DNA, 19 bp, Artificial Sequence
  Description of Artificial Sequence: Chemically synthesized oligonucleotide
cagaatgattcccaagttt

SEQ ID NO: 10759 - DNA, 19 bp, Artificial Sequence
  Description of Artificial Sequence: Chemically synthesized oligonucleotide
aacttgggaatcattctgg

SEQ ID NO: 10760 - DNA, 19 bp, Artificial Sequence
  Description of Artificial Sequence: Chemically synthesized oligonucleotide
ccagaatgattcccaagtt

SEQ ID NO: 10761 - DNA, 19 bp, Artificial Sequence
  Description of Artificial Sequence: Chemically synthesized oligonucleotide
acttgggaatcattctggc

SEQ ID NO: 10762 - DNA, 19 bp, Artificial Sequence
  Description of Artificial Sequence: Chemically synthesized oligonucleotide
gccagaatgattcccaagt

SEQ ID NO: 10763 - DNA, 19 bp, Artificial Sequence
  Description of Artificial Sequence: Chemically synthesized oligonucleotide
cttgggaatcattctggct

SEQ ID NO: 10764 - DNA, 19 bp, Artificial Sequence
  Description of Artificial Sequence: Chemically synthesized oligonucleotide
agccagaatgattcccaag

SEQ ID NO: 10765 - DNA, 19 bp, Artificial Sequence
  Description of Artificial Sequence: Chemically synthesized oligonucleotide
ttgggaatcattctggctt

SEQ ID NO: 10766 - DNA, 19 bp, Artificial Sequence
  Description of Artificial Sequence: Chemically synthesized oligonucleotide
aagccagaatgattcccaa

SEQ ID NO: 10767 - DNA, 19 bp, Artificial Sequence
  Description of Artificial Sequence: Chemically synthesized oligonucleotide
tgggaatcattctggctta

SEQ ID NO: 10768 - DNA, 19 bp, Artificial Sequence
  Description of Artificial Sequence: Chemically synthesized oligonucleotide
taagccagaatgattccca

SEQ ID NO: 10769 - DNA, 19 bp, Artificial Sequence
  Description of Artificial Sequence: Chemically synthesized oligonucleotide
gggaatcattctggcttaa

SEQ ID NO: 10770 - DNA, 19 bp, Artificial Sequence
  Description of Artificial Sequence: Chemically synthesized oligonucleotide
ttaagccagaatgattccc

SEQ ID NO: 10771 - DNA, 19 bp, Artificial Sequence
  Description of Artificial Sequence: Chemically synthesized oligonucleotide
ggaatcattctggcttaaa

SEQ ID NO: 10772 - DNA, 19 bp, Artificial Sequence
  Description of Artificial Sequence: Chemically synthesized oligonucleotide
tttaagccagaatgattcc

SEQ ID NO: 10773 - DNA, 19 bp, Artificial Sequence
  Description of Artificial Sequence: Chemically synthesized oligonucleotide
gaatcattctggcttaaac

SEQ ID NO: 10774 - DNA, 19 bp, Artificial Sequence
  Description of Artificial Sequence: Chemically synthesized oligonucleotide
gtttaagccagaatgattc

SEQ ID NO: 10775 - DNA, 19 bp, Artificial Sequence
  Description of Artificial Sequence: Chemically synthesized oligonucleotide
aatcattctggcttaaaca

SEQ ID NO: 10776 - DNA, 19 bp, Artificial Sequence
  Description of Artificial Sequence: Chemically synthesized oligonucleotide
tgtttaagccagaatgatt

SEQ ID NO: 10777 - DNA, 19 bp, Artificial Sequence
  Description of Artificial Sequence: Chemically synthesized oligonucleotide
atcattctggcttaaacaa

SEQ ID NO: 10778 - DNA, 19 bp, Artificial Sequence
  Description of Artificial Sequence: Chemically synthesized oligonucleotide
ttgtttaagccagaatgat

SEQ ID NO: 10779 - DNA, 19 bp, Artificial Sequence
  Description of Artificial Sequence: Chemically synthesized oligonucleotide
tcattctggcttaaacaac

SEQ ID NO: 10780 - DNA, 19 bp, Artificial Sequence
  Description of Artificial Sequence: Chemically synthesized oligonucleotide
gttgtttaagccagaatga

SEQ ID NO: 10781 - DNA, 19 bp, Artificial Sequence
  Description of Artificial Sequence: Chemically synthesized oligonucleotide
cattctggcttaaacaaca

SEQ ID NO: 10782 - DNA, 19 bp, Artificial Sequence
  Description of Artificial Sequence: Chemically synthesized oligonucleotide
tgttgtttaagccagaatg

SEQ ID NO: 10783 - DNA, 19 bp, Artificial Sequence
  Description of Artificial Sequence: Chemically synthesized oligonucleotide
attctggcttaaacaacac

SEQ ID NO: 10784 - DNA, 19 bp, Artificial Sequence
  Description of Artificial Sequence: Chemically synthesized oligonucleotide
gtgttgtttaagccagaat

SEQ ID NO: 10785 - DNA, 19 bp, Artificial Sequence
  Description of Artificial Sequence: Chemically synthesized oligonucleotide
ttctggcttaaacaacacc

SEQ ID NO: 10786 - DNA, 19 bp, Artificial Sequence
  Description of Artificial Sequence: Chemically synthesized oligonucleotide
ggtgttgtttaagccagaa

SEQ ID NO: 10787 - DNA, 19 bp, Artificial Sequence
  Description of Artificial Sequence: Chemically synthesized oligonucleotide
tctggcttaaacaacacct

SEQ ID NO: 10788 - DNA, 19 bp, Artificial Sequence
  Description of Artificial Sequence: Chemically synthesized oligonucleotide
aggtgttgtttaagccaga

SEQ ID NO: 10789 - DNA, 19 bp, Artificial Sequence
  Description of Artificial Sequence: Chemically synthesized oligonucleotide
ctggcttaaacaacacctc

SEQ ID NO: 10790 - DNA, 19 bp, Artificial Sequence
  Description of Artificial Sequence: Chemically synthesized oligonucleotide
gaggtgttgtttaagccag

SEQ ID NO: 10791 - DNA, 19 bp, Artificial Sequence
  Description of Artificial Sequence: Chemically synthesized oligonucleotide
tggcttaaacaacacctcc

SEQ ID NO: 10792 - DNA, 19 bp, Artificial Sequence
  Description of Artificial Sequence: Chemically synthesized oligonucleotide
ggaggtgttgtttaagcca

SEQ ID NO: 10793 - DNA, 19 bp, Artificial Sequence
  Description of Artificial Sequence: Chemically synthesized oligonucleotide
ggcttaaacaacacctcct

SEQ ID NO: 10794 - DNA, 19 bp, Artificial Sequence
  Description of Artificial Sequence: Chemically synthesized oligonucleotide
aggaggtgttgtttaagcc

SEQ ID NO: 10795 - DNA, 19 bp, Artificial Sequence
  Description of Artificial Sequence: Chemically synthesized oligonucleotide
gcttaaacaacacctcctc

SEQ ID NO: 10796 - DNA, 19 bp, Artificial Sequence
  Description of Artificial Sequence: Chemically synthesized oligonucleotide
gaggaggtgttgtttaagc

SEQ ID NO: 10797 - DNA, 19 bp, Artificial Sequence
  Description of Artificial Sequence: Chemically synthesized oligonucleotide
cttaaacaacacctcctcc

SEQ ID NO: 10798 - DNA, 19 bp, Artificial Sequence
  Description of Artificial Sequence: Chemically synthesized oligonucleotide
ggaggaggtgttgtttaag

SEQ ID NO: 10799 - DNA, 19 bp, Artificial Sequence
  Description of Artificial Sequence: Chemically synthesized oligonucleotide
ttaaacaacacctcctcct

SEQ ID NO: 10800 - DNA, 19 bp, Artificial Sequence
  Description of Artificial Sequence: Chemically synthesized oligonucleotide
aggaggaggtgttgtttaa

SEQ ID NO: 10801 - DNA, 19 bp, Artificial Sequence
  Description of Artificial Sequence: Chemically synthesized oligonucleotide
taaacaacacctcctcctg

SEQ ID NO: 10802 - DNA, 19 bp, Artificial Sequence
  Description of Artificial Sequence: Chemically synthesized oligonucleotide
caggaggaggtgttgttta

SEQ ID NO: 10803 - DNA, 19 bp, Artificial Sequence
  Description of Artificial Sequence: Chemically synthesized oligonucleotide
aaacaacacctcctcctgc

SEQ ID NO: 10804 - DNA, 19 bp, Artificial Sequence
  Description of Artificial Sequence: Chemically synthesized oligonucleotide
gcaggaggaggtgttgttt

SEQ ID NO: 10805 - DNA, 19 bp, Artificial Sequence
  Description of Artificial Sequence: Chemically synthesized oligonucleotide
aacaacacctcctcctgct

SEQ ID NO: 10806 - DNA, 19 bp, Artificial Sequence
  Description of Artificial Sequence: Chemically synthesized oligonucleotide
agcaggaggaggtgttgtt

SEQ ID NO: 10807 - DNA, 19 bp, Artificial Sequence
  Description of Artificial Sequence: Chemically synthesized oligonucleotide
acaacacctcctcctgctg

SEQ ID NO: 10808 - DNA, 19 bp, Artificial Sequence
  Description of Artificial Sequence: Chemically synthesized oligonucleotide
cagcaggaggaggtgttgt

SEQ ID NO: 10809 - DNA, 19 bp, Artificial Sequence
  Description of Artificial Sequence: Chemically synthesized oligonucleotide
caacacctcctcctgctgc

SEQ ID NO: 10810 - DNA, 19 bp, Artificial Sequence
  Description of Artificial Sequence: Chemically synthesized oligonucleotide
gcagcaggaggaggtgttg

SEQ ID NO: 10811 - DNA, 19 bp, Artificial Sequence
  Description of Artificial Sequence: Chemically synthesized oligonucleotide
aacacctcctcctgctgct

SEQ ID NO: 10812 - DNA, 19 bp, Artificial Sequence
  Description of Artificial Sequence: Chemically synthesized oligonucleotide
agcagcaggaggaggtgtt

SEQ ID NO: 10813 - DNA, 19 bp, Artificial Sequence
  Description of Artificial Sequence: Chemically synthesized oligonucleotide
acacctcctcctgctgctc

SEQ ID NO: 10814 - DNA, 19 bp, Artificial Sequence
  Description of Artificial Sequence: Chemically synthesized oligonucleotide
gagcagcaggaggaggtgt

SEQ ID NO: 10815 - DNA, 19 bp, Artificial Sequence
  Description of Artificial Sequence: Chemically synthesized oligonucleotide
cacctcctcctgctgctca

SEQ ID NO: 10816 - DNA, 19 bp, Artificial Sequence
  Description of Artificial Sequence: Chemically synthesized oligonucleotide
tgagcagcaggaggaggtg

SEQ ID NO: 10817 - DNA, 19 bp, Artificial Sequence
  Description of Artificial Sequence: Chemically synthesized oligonucleotide
acctcctcctgctgctcac

SEQ ID NO: 10818 - DNA, 19 bp, Artificial Sequence
  Description of Artificial Sequence: Chemically synthesized oligonucleotide
gtgagcagcaggaggaggt

SEQ ID NO: 10819 - DNA, 19 bp, Artificial Sequence
  Description of Artificial Sequence: Chemically synthesized oligonucleotide
cctcctcctgctgctcact

SEQ ID NO: 10820 - DNA, 19 bp, Artificial Sequence
  Description of Artificial Sequence: Chemically synthesized oligonucleotide
agtgagcagcaggaggagg

SEQ ID NO: 10821 - DNA, 19 bp, Artificial Sequence
  Description of Artificial Sequence: Chemically synthesized oligonucleotide
ctcctcctgctgctcactc

SEQ ID NO: 10822 - DNA, 19 bp, Artificial Sequence
  Description of Artificial Sequence: Chemically synthesized oligonucleotide
gagtgagcagcaggaggag

SEQ ID NO: 10823 - DNA, 19 bp, Artificial Sequence
  Description of Artificial Sequence: Chemically synthesized oligonucleotide
tcctcctgctgctcactcc

SEQ ID NO: 10824 - DNA, 19 bp, Artificial Sequence
  Description of Artificial Sequence: Chemically synthesized oligonucleotide
ggagtgagcagcaggagga

SEQ ID NO: 10825 - DNA, 19 bp, Artificial Sequence
  Description of Artificial Sequence: Chemically synthesized oligonucleotide
cctcctgctgctcactccc

SEQ ID NO: 10826 - DNA, 19 bp, Artificial Sequence
  Description of Artificial Sequence: Chemically synthesized oligonucleotide
gggagtgagcagcaggagg

SEQ ID NO: 10827 - DNA, 19 bp, Artificial Sequence
  Description of Artificial Sequence: Chemically synthesized oligonucleotide
ctcctgctgctcactcccg

SEQ ID NO: 10828 - DNA, 19 bp, Artificial Sequence
  Description of Artificial Sequence: Chemically synthesized oligonucleotide
cgggagtgagcagcaggag

SEQ ID NO: 10829 - DNA, 19 bp, Artificial Sequence
  Description of Artificial Sequence: Chemically synthesized oligonucleotide
tcctgctgctcactcccgc

SEQ ID NO: 10830 - DNA, 19 bp, Artificial Sequence
  Description of Artificial Sequence: Chemically synthesized oligonucleotide
gcgggagtgagcagcagga

SEQ ID NO: 10831 - DNA, 19 bp, Artificial Sequence
  Description of Artificial Sequence: Chemically synthesized oligonucleotide
cctgctgctcactcccgct

SEQ ID NO: 10832 - DNA, 19 bp, Artificial Sequence
  Description of Artificial Sequence: Chemically synthesized oligonucleotide
agcgggagtgagcagcagg

SEQ ID NO: 10833 - DNA, 19 bp, Artificial Sequence
  Description of Artificial Sequence: Chemically synthesized oligonucleotide
ctgctgctcactcccgctg

SEQ ID NO: 10834 - DNA, 19 bp, Artificial Sequence
  Description of Artificial Sequence: Chemically synthesized oligonucleotide
cagcgggagtgagcagcag

SEQ ID NO: 10835 - DNA, 19 bp, Artificial Sequence
  Description of Artificial Sequence: Chemically synthesized oligonucleotide
tgctgctcactcccgctga

SEQ ID NO: 10836 - DNA, 19 bp, Artificial Sequence
  Description of Artificial Sequence: Chemically synthesized oligonucleotide
tcagcgggagtgagcagca

SEQ ID NO: 10837 - DNA, 19 bp, Artificial Sequence
  Description of Artificial Sequence: Chemically synthesized oligonucleotide
gctgctcactcccgctgag

SEQ ID NO: 10838 - DNA, 19 bp, Artificial Sequence
  Description of Artificial Sequence: Chemically synthesized oligonucleotide
ctcagcgggagtgagcagc

SEQ ID NO: 10839 - DNA, 19 bp, Artificial Sequence
  Description of Artificial Sequence: Chemically synthesized oligonucleotide
ctgctcactcccgctgagc

SEQ ID NO: 10840 - DNA, 19 bp, Artificial Sequence
  Description of Artificial Sequence: Chemically synthesized oligonucleotide
gctcagcgggagtgagcag

SEQ ID NO: 10841 - DNA, 19 bp, Artificial Sequence
  Description of Artificial Sequence: Chemically synthesized oligonucleotide
tgctcactcccgctgagcc

SEQ ID NO: 10842 - DNA, 19 bp, Artificial Sequence
  Description of Artificial Sequence: Chemically synthesized oligonucleotide
ggctcagcgggagtgagca

SEQ ID NO: 10843 - DNA, 19 bp, Artificial Sequence
  Description of Artificial Sequence: Chemically synthesized oligonucleotide
gctcactcccgctgagccc

SEQ ID NO: 10844 - DNA, 19 bp, Artificial Sequence
  Description of Artificial Sequence: Chemically synthesized oligonucleotide
gggctcagcgggagtgagc

SEQ ID NO: 10845 - DNA, 19 bp, Artificial Sequence
  Description of Artificial Sequence: Chemically synthesized oligonucleotide
ctcactcccgctgagccca

SEQ ID NO: 10846 - DNA, 19 bp, Artificial Sequence
  Description of Artificial Sequence: Chemically synthesized oligonucleotide
tgggctcagcgggagtgag

SEQ ID NO: 10847 - DNA, 19 bp, Artificial Sequence
  Description of Artificial Sequence: Chemically synthesized oligonucleotide
tcactcccgctgagcccac

SEQ ID NO: 10848 - DNA, 19 bp, Artificial Sequence
  Description of Artificial Sequence: Chemically synthesized oligonucleotide
gtgggctcagcgggagtga

SEQ ID NO: 10849 - DNA, 19 bp, Artificial Sequence
  Description of Artificial Sequence: Chemically synthesized oligonucleotide
cactcccgctgagcccact

SEQ ID NO: 10850 - DNA, 19 bp, Artificial Sequence
  Description of Artificial Sequence: Chemically synthesized oligonucleotide
agtgggctcagcgggagtg

SEQ ID NO: 10851 - DNA, 19 bp, Artificial Sequence
  Description of Artificial Sequence: Chemically synthesized oligonucleotide
actcccgctgagcccactc

SEQ ID NO: 10852 - DNA, 19 bp, Artificial Sequence
  Description of Artificial Sequence: Chemically synthesized oligonucleotide
gagtgggctcagcgggagt

SEQ ID NO: 10853 - DNA, 19 bp, Artificial Sequence
  Description of Artificial Sequence: Chemically synthesized oligonucleotide
ctcccgctgagcccactct

SEQ ID NO: 10854 - DNA, 19 bp, Artificial Sequence
  Description of Artificial Sequence: Chemically synthesized oligonucleotide
agagtgggctcagcgggag

SEQ ID NO: 10855 - DNA, 19 bp, Artificial Sequence
  Description of Artificial Sequence: Chemically synthesized oligonucleotide
tcccgctgagcccactcta

SEQ ID NO: 10856 - DNA, 19 bp, Artificial Sequence
  Description of Artificial Sequence: Chemically synthesized oligonucleotide
tagagtgggctcagcggga

SEQ ID NO: 10857 - DNA, 19 bp, Artificial Sequence
  Description of Artificial Sequence: Chemically synthesized oligonucleotide
cccgctgagcccactctac

SEQ ID NO: 10858 - DNA, 19 bp, Artificial Sequence
  Description of Artificial Sequence: Chemically synthesized oligonucleotide
gtagagtgggctcagcggg

SEQ ID NO: 10859 - DNA, 19 bp, Artificial Sequence
  Description of Artificial Sequence: Chemically synthesized oligonucleotide
ccgctgagcccactctact

SEQ ID NO: 10860 - DNA, 19 bp, Artificial Sequence
  Description of Artificial Sequence: Chemically synthesized oligonucleotide
agtagagtgggctcagcgg

SEQ ID NO: 10861 - DNA, 19 bp, Artificial Sequence
  Description of Artificial Sequence: Chemically synthesized oligonucleotide
cgctgagcccactctactg

SEQ ID NO: 10862 - DNA, 19 bp, Artificial Sequence
  Description of Artificial Sequence: Chemically synthesized oligonucleotide
cagtagagtgggctcagcg

SEQ ID NO: 10863 - DNA, 19 bp, Artificial Sequence
  Description of Artificial Sequence: Chemically synthesized oligonucleotide
gctgagcccactctactgc

SEQ ID NO: 10864 - DNA, 19 bp, Artificial Sequence
  Description of Artificial Sequence: Chemically synthesized oligonucleotide
gcagtagagtgggctcagc

SEQ ID NO: 10865 - DNA, 19 bp, Artificial Sequence
  Description of Artificial Sequence: Chemically synthesized oligonucleotide
ctgagcccactctactgcc

SEQ ID NO: 10866 - DNA, 19 bp, Artificial Sequence
  Description of Artificial Sequence: Chemically synthesized oligonucleotide
ggcagtagagtgggctcag

SEQ ID NO: 10867 - DNA, 19 bp, Artificial Sequence
  Description of Artificial Sequence: Chemically synthesized oligonucleotide
tgagcccactctactgccc

SEQ ID NO: 10868 - DNA, 19 bp, Artificial Sequence
  Description of Artificial Sequence: Chemically synthesized oligonucleotide
gggcagtagagtgggctca

SEQ ID NO: 10869 - DNA, 19 bp, Artificial Sequence
  Description of Artificial Sequence: Chemically synthesized oligonucleotide
gagcccactctactgcccc

SEQ ID NO: 10870 - DNA, 19 bp, Artificial Sequence
  Description of Artificial Sequence: Chemically synthesized oligonucleotide
ggggcagtagagtgggctc

SEQ ID NO: 10871 - DNA, 19 bp, Artificial Sequence
  Description of Artificial Sequence: Chemically synthesized oligonucleotide
agcccactctactgcccca

SEQ ID NO: 10872 - DNA, 19 bp, Artificial Sequence
  Description of Artificial Sequence: Chemically synthesized oligonucleotide
tggggcagtagagtgggct

SEQ ID NO: 10873 - DNA, 19 bp, Artificial Sequence
  Description of Artificial Sequence: Chemically synthesized oligonucleotide
gcccactctactgccccag

SEQ ID NO: 10874 - DNA, 19 bp, Artificial Sequence
  Description of Artificial Sequence: Chemically synthesized oligonucleotide
ctggggcagtagagtgggc

SEQ ID NO: 10875 - DNA, 19 bp, Artificial Sequence
  Description of Artificial Sequence: Chemically synthesized oligonucleotide
cccactctactgccccagc

SEQ ID NO: 10876 - DNA, 19 bp, Artificial Sequence
  Description of Artificial Sequence: Chemically synthesized oligonucleotide
gctggggcagtagagtggg

SEQ ID NO: 10877 - DNA, 19 bp, Artificial Sequence
  Description of Artificial Sequence: Chemically synthesized oligonucleotide
ccactctactgccccagct

SEQ ID NO: 10878 - DNA, 19 bp, Artificial Sequence
  Description of Artificial Sequence: Chemically synthesized oligonucleotide
agctggggcagtagagtgg

SEQ ID NO: 10879 - DNA, 19 bp, Artificial Sequence
  Description of Artificial Sequence: Chemically synthesized oligonucleotide
cactctactgccccagctc

SEQ ID NO: 10880 - DNA, 19 bp, Artificial Sequence
  Description of Artificial Sequence: Chemically synthesized oligonucleotide
gagctggggcagtagagtg

SEQ ID NO: 10881 - DNA, 19 bp, Artificial Sequence
  Description of Artificial Sequence: Chemically synthesized oligonucleotide
actctactgccccagctcc

SEQ ID NO: 10882 - DNA, 19 bp, Artificial Sequence
  Description of Artificial Sequence: Chemically synthesized oligonucleotide
ggagctggggcagtagagt

SEQ ID NO: 10883 - DNA, 19 bp, Artificial Sequence
  Description of Artificial Sequence: Chemically synthesized oligonucleotide
ctctactgccccagctccg

SEQ ID NO: 10884 - DNA, 19 bp, Artificial Sequence
  Description of Artificial Sequence: Chemically synthesized oligonucleotide
cggagctggggcagtagag

SEQ ID NO: 10885 - DNA, 19 bp, Artificial Sequence
  Description of Artificial Sequence: Chemically synthesized oligonucleotide
tctactgccccagctccgt

SEQ ID NO: 10886 - DNA, 19 bp, Artificial Sequence
  Description of Artificial Sequence: Chemically synthesized oligonucleotide
acggagctggggcagtaga

SEQ ID NO: 10887 - DNA, 19 bp, Artificial Sequence
  Description of Artificial Sequence: Chemically synthesized oligonucleotide
ctactgccccagctccgtt

SEQ ID NO: 10888 - DNA, 19 bp, Artificial Sequence
  Description of Artificial Sequence: Chemically synthesized oligonucleotide
aacggagctggggcagtag

SEQ ID NO: 10889 - DNA, 19 bp, Artificial Sequence
  Description of Artificial Sequence: Chemically synthesized oligonucleotide
tactgccccagctccgttt

SEQ ID NO: 10890 - DNA, 19 bp, Artificial Sequence
  Description of Artificial Sequence: Chemically synthesized oligonucleotide
aaacggagctggggcagta

SEQ ID NO: 10891 - DNA, 19 bp, Artificial Sequence
  Description of Artificial Sequence: Chemically synthesized oligonucleotide
actgccccagctccgtttc

SEQ ID NO: 10892 - DNA, 19 bp, Artificial Sequence
  Description of Artificial Sequence: Chemically synthesized oligonucleotide
gaaacggagctggggcagt

SEQ ID NO: 10893 - DNA, 19 bp, Artificial Sequence
  Description of Artificial Sequence: Chemically synthesized oligonucleotide
ctgccccagctccgtttct

SEQ ID NO: 10894 - DNA, 19 bp, Artificial Sequence
  Description of Artificial Sequence: Chemically synthesized oligonucleotide
agaaacggagctggggcag

SEQ ID NO: 10895 - DNA, 19 bp, Artificial Sequence
  Description of Artificial Sequence: Chemically synthesized oligonucleotide
tgccccagctccgtttcta

SEQ ID NO: 10896 - DNA, 19 bp, Artificial Sequence
  Description of Artificial Sequence: Chemically synthesized oligonucleotide
tagaaacggagctggggca

SEQ ID NO: 10897 - DNA, 19 bp, Artificial Sequence
  Description of Artificial Sequence: Chemically synthesized oligonucleotide
gccccagctccgtttctac

SEQ ID NO: 10898 - DNA, 19 bp, Artificial Sequence
  Description of Artificial Sequence: Chemically synthesized oligonucleotide
gtagaaacggagctggggc

SEQ ID NO: 10899 - DNA, 19 bp, Artificial Sequence
  Description of Artificial Sequence: Chemically synthesized oligonucleotide
ccccagctccgtttctacc

SEQ ID NO: 10900 - DNA, 19 bp, Artificial Sequence
  Description of Artificial Sequence: Chemically synthesized oligonucleotide
ggtagaaacggagctgggg

SEQ ID NO: 10901 - DNA, 19 bp, Artificial Sequence
  Description of Artificial Sequence: Chemically synthesized oligonucleotide
cccagctccgtttctacca

SEQ ID NO: 10902 - DNA, 19 bp, Artificial Sequence
  Description of Artificial Sequence: Chemically synthesized oligonucleotide
tggtagaaacggagctggg

SEQ ID NO: 10903 - DNA, 19 bp, Artificial Sequence
  Description of Artificial Sequence: Chemically synthesized oligonucleotide
ccagctccgtttctaccac

SEQ ID NO: 10904 - DNA, 19 bp, Artificial Sequence
  Description of Artificial Sequence: Chemically synthesized oligonucleotide
gtggtagaaacggagctgg

SEQ ID NO: 10905 - DNA, 19 bp, Artificial Sequence
  Description of Artificial Sequence: Chemically synthesized oligonucleotide
cagctccgtttctaccacc

SEQ ID NO: 10906 - DNA, 19 bp, Artificial Sequence
  Description of Artificial Sequence: Chemically synthesized oligonucleotide
ggtggtagaaacggagctg

SEQ ID NO: 10907 - DNA, 19 bp, Artificial Sequence
  Description of Artificial Sequence: Chemically synthesized oligonucleotide
agctccgtttctaccaccg

SEQ ID NO: 10908 - DNA, 19 bp, Artificial Sequence
  Description of Artificial Sequence: Chemically synthesized oligonucleotide
cggtggtagaaacggagct

SEQ ID NO: 10909 - DNA, 19 bp, Artificial Sequence
  Description of Artificial Sequence: Chemically synthesized oligonucleotide
gctccgtttctaccaccgc

SEQ ID NO: 10910 - DNA, 19 bp, Artificial Sequence
  Description of Artificial Sequence: Chemically synthesized oligonucleotide
gcggtggtagaaacggagc

SEQ ID NO: 10911 - DNA, 19 bp, Artificial Sequence
  Description of Artificial Sequence: Chemically synthesized oligonucleotide
ctccgtttctaccaccgca

SEQ ID NO: 10912 - DNA, 19 bp, Artificial Sequence
  Description of Artificial Sequence: Chemically synthesized oligonucleotide
tgcggtggtagaaacggag

SEQ ID NO: 10913 - DNA, 19 bp, Artificial Sequence
  Description of Artificial Sequence: Chemically synthesized oligonucleotide
tccgtttctaccaccgcat

SEQ ID NO: 10914 - DNA, 19 bp, Artificial Sequence
  Description of Artificial Sequence: Chemically synthesized oligonucleotide
atgcggtggtagaaacgga

SEQ ID NO: 10915 - DNA, 19 bp, Artificial Sequence
  Description of Artificial Sequence: Chemically synthesized oligonucleotide
ccgtttctaccaccgcatc

SEQ ID NO: 10916 - DNA, 19 bp, Artificial Sequence
  Description of Artificial Sequence: Chemically synthesized oligonucleotide
gatgcggtggtagaaacgg

SEQ ID NO: 10917 - DNA, 19 bp, Artificial Sequence
  Description of Artificial Sequence: Chemically synthesized oligonucleotide
cgtttctaccaccgcatcc

SEQ ID NO: 10918 - DNA, 19 bp, Artificial Sequence
  Description of Artificial Sequence: Chemically synthesized oligonucleotide
ggatgcggtggtagaaacg

SEQ ID NO: 10919 - DNA, 19 bp, Artificial Sequence
  Description of Artificial Sequence: Chemically synthesized oligonucleotide
gtttctaccaccgcatcct

SEQ ID NO: 10920 - DNA, 19 bp, Artificial Sequence
  Description of Artificial Sequence: Chemically synthesized oligonucleotide
aggatgcggtggtagaaac

SEQ ID NO: 10921 - DNA, 19 bp, Artificial Sequence
  Description of Artificial Sequence: Chemically synthesized oligonucleotide
tttctaccaccgcatcctc

SEQ ID NO: 10922 - DNA, 19 bp, Artificial Sequence
  Description of Artificial Sequence: Chemically synthesized oligonucleotide
gaggatgcggtggtagaaa

SEQ ID NO: 10923 - DNA, 19 bp, Artificial Sequence
  Description of Artificial Sequence: Chemically synthesized oligonucleotide
ttctaccaccgcatcctca

SEQ ID NO: 10924 - DNA, 19 bp, Artificial Sequence
  Description of Artificial Sequence: Chemically synthesized oligonucleotide
tgaggatgcggtggtagaa

SEQ ID NO: 10925 - DNA, 19 bp, Artificial Sequence
  Description of Artificial Sequence: Chemically synthesized oligonucleotide
tctaccaccgcatcctcac

SEQ ID NO: 10926 - DNA, 19 bp, Artificial Sequence
  Description of Artificial Sequence: Chemically synthesized oligonucleotide
gtgaggatgcggtggtaga

SEQ ID NO: 10927 - DNA, 19 bp, Artificial Sequence
  Description of Artificial Sequence: Chemically synthesized oligonucleotide
ctaccaccgcatcctcact

SEQ ID NO: 10928 - DNA, 19 bp, Artificial Sequence
  Description of Artificial Sequence: Chemically synthesized oligonucleotide
agtgaggatgcggtggtag

SEQ ID NO: 10929 - DNA, 19 bp, Artificial Sequence
  Description of Artificial Sequence: Chemically synthesized oligonucleotide
taccaccgcatcctcactg

SEQ ID NO: 10930 - DNA, 19 bp, Artificial Sequence
  Description of Artificial Sequence: Chemically synthesized oligonucleotide
cagtgaggatgcggtggta

SEQ ID NO: 10931 - DNA, 19 bp, Artificial Sequence
  Description of Artificial Sequence: Chemically synthesized oligonucleotide
accaccgcatcctcactgg

SEQ ID NO: 10932 - DNA, 19 bp, Artificial Sequence
  Description of Artificial Sequence: Chemically synthesized oligonucleotide
ccagtgaggatgcggtggt

SEQ ID NO: 10933 - DNA, 19 bp, Artificial Sequence
  Description of Artificial Sequence: Chemically synthesized oligonucleotide
ccaccgcatcctcactggg

SEQ ID NO: 10934 - DNA, 19 bp, Artificial Sequence
  Description of Artificial Sequence: Chemically synthesized oligonucleotide
cccagtgaggatgcggtgg

SEQ ID NO: 10935 - DNA, 19 bp, Artificial Sequence
  Description of Artificial Sequence: Chemically synthesized oligonucleotide
caccgcatcctcactgggc

SEQ ID NO: 10936 - DNA, 19 bp, Artificial Sequence
  Description of Artificial Sequence: Chemically synthesized oligonucleotide
gcccagtgaggatgcggtg

SEQ ID NO: 10937 - DNA, 19 bp, Artificial Sequence
  Description of Artificial Sequence: Chemically synthesized oligonucleotide
accgcatcctcactgggct

SEQ ID NO: 10938 - DNA, 19 bp, Artificial Sequence
  Description of Artificial Sequence: Chemically synthesized oligonucleotide
agcccagtgaggatgcggt

SEQ ID NO: 10939 - DNA, 19 bp, Artificial Sequence
  Description of Artificial Sequence: Chemically synthesized oligonucleotide
ccgcatcctcactgggctc

SEQ ID NO: 10940 - DNA, 19 bp, Artificial Sequence
  Description of Artificial Sequence: Chemically synthesized oligonucleotide
gagcccagtgaggatgcgg

SEQ ID NO: 10941 - DNA, 19 bp, Artificial Sequence
  Description of Artificial Sequence: Chemically synthesized oligonucleotide
cgcatcctcactgggctca

SEQ ID NO: 10942 - DNA, 19 bp, Artificial Sequence
  Description of Artificial Sequence: Chemically synthesized oligonucleotide
tgagcccagtgaggatgcg

SEQ ID NO: 10943 - DNA, 19 bp, Artificial Sequence
  Description of Artificial Sequence: Chemically synthesized oligonucleotide
gcatcctcactgggctcac

SEQ ID NO: 10944 - DNA, 19 bp, Artificial Sequence
  Description of Artificial Sequence: Chemically synthesized oligonucleotide
gtgagcccagtgaggatgc

SEQ ID NO: 10945 - DNA, 19 bp, Artificial Sequence
  Description of Artificial Sequence: Chemically synthesized oligonucleotide
catcctcactgggctcact

SEQ ID NO: 10946 - DNA, 19 bp, Artificial Sequence
  Description of Artificial Sequence: Chemically synthesized oligonucleotide
agtgagcccagtgaggatg

SEQ ID NO: 10947 - DNA, 19 bp, Artificial Sequence
  Description of Artificial Sequence: Chemically synthesized oligonucleotide
atcctcactgggctcactg

SEQ ID NO: 10948 - DNA, 19 bp, Artificial Sequence
  Description of Artificial Sequence: Chemically synthesized oligonucleotide
cagtgagcccagtgaggat

SEQ ID NO: 10949 - DNA, 19 bp, Artificial Sequence
  Description of Artificial Sequence: Chemically synthesized oligonucleotide
tcctcactgggctcactgc

SEQ ID NO: 10950 - DNA, 19 bp, Artificial Sequence
  Description of Artificial Sequence: Chemically synthesized oligonucleotide
gcagtgagcccagtgagga

SEQ ID NO: 10951 - DNA, 19 bp, Artificial Sequence
  Description of Artificial Sequence: Chemically synthesized oligonucleotide
cctcactgggctcactgca

SEQ ID NO: 10952 - DNA, 19 bp, Artificial Sequence
  Description of Artificial Sequence: Chemically synthesized oligonucleotide
tgcagtgagcccagtgagg

SEQ ID NO: 10953 - DNA, 19 bp, Artificial Sequence
  Description of Artificial Sequence: Chemically synthesized oligonucleotide
ctcactgggctcactgcag

SEQ ID NO: 10954 - DNA, 19 bp, Artificial Sequence
  Description of Artificial Sequence: Chemically synthesized oligonucleotide
ctgcagtgagcccagtgag

SEQ ID NO: 10955 - DNA, 19 bp, Artificial Sequence
  Description of Artificial Sequence: Chemically synthesized oligonucleotide
tcactgggctcactgcagg

SEQ ID NO: 10956 - DNA, 19 bp, Artificial Sequence
  Description of Artificial Sequence: Chemically synthesized oligonucleotide
cctgcagtgagcccagtga

SEQ ID NO: 10957 - DNA, 19 bp, Artificial Sequence
  Description of Artificial Sequence: Chemically synthesized oligonucleotide
cactgggctcactgcaggc

SEQ ID NO: 10958 - DNA, 19 bp, Artificial Sequence
  Description of Artificial Sequence: Chemically synthesized oligonucleotide
gcctgcagtgagcccagtg

SEQ ID NO: 10959 - DNA, 19 bp, Artificial Sequence
  Description of Artificial Sequence: Chemically synthesized oligonucleotide
actgggctcactgcaggca

SEQ ID NO: 10960 - DNA, 19 bp, Artificial Sequence
  Description of Artificial Sequence: Chemically synthesized oligonucleotide
tgcctgcagtgagcccagt

SEQ ID NO: 10961 - DNA, 19 bp, Artificial Sequence
  Description of Artificial Sequence: Chemically synthesized oligonucleotide
ctgggctcactgcaggcat

SEQ ID NO: 10962 - DNA, 19 bp, Artificial Sequence
  Description of Artificial Sequence: Chemically synthesized oligonucleotide
atgcctgcagtgagcccag

SEQ ID NO: 10963 - DNA, 19 bp, Artificial Sequence
  Description of Artificial Sequence: Chemically synthesized oligonucleotide
tgggctcactgcaggcatg

SEQ ID NO: 10964 - DNA, 19 bp, Artificial Sequence
  Description of Artificial Sequence: Chemically synthesized oligonucleotide
catgcctgcagtgagccca

SEQ ID NO: 10965 - DNA, 19 bp, Artificial Sequence
  Description of Artificial Sequence: Chemically synthesized oligonucleotide
gggctcactgcaggcatgc

SEQ ID NO: 10966 - DNA, 19 bp, Artificial Sequence
  Description of Artificial Sequence: Chemically synthesized oligonucleotide
gcatgcctgcagtgagccc

SEQ ID NO: 10967 - DNA, 19 bp, Artificial Sequence
  Description of Artificial Sequence: Chemically synthesized oligonucleotide
ggctcactgcaggcatgct

SEQ ID NO: 10968 - DNA, 19 bp, Artificial Sequence
  Description of Artificial Sequence: Chemically synthesized oligonucleotide
agcatgcctgcagtgagcc

SEQ ID NO: 10969 - DNA, 19 bp, Artificial Sequence
  Description of Artificial Sequence: Chemically synthesized oligonucleotide
gctcactgcaggcatgctg

SEQ ID NO: 10970 - DNA, 19 bp, Artificial Sequence
  Description of Artificial Sequence: Chemically synthesized oligonucleotide
cagcatgcctgcagtgagc

SEQ ID NO: 10971 - DNA, 19 bp, Artificial Sequence
  Description of Artificial Sequence: Chemically synthesized oligonucleotide
ctcactgcaggcatgctga

SEQ ID NO: 10972 - DNA, 19 bp, Artificial Sequence
  Description of Artificial Sequence: Chemically synthesized oligonucleotide
tcagcatgcctgcagtgag

SEQ ID NO: 10973 - DNA, 19 bp, Artificial Sequence
  Description of Artificial Sequence: Chemically synthesized oligonucleotide
tcactgcaggcatgctgaa

SEQ ID NO: 10974 - DNA, 19 bp, Artificial Sequence
  Description of Artificial Sequence: Chemically synthesized oligonucleotide
ttcagcatgcctgcagtga

SEQ ID NO: 10975 - DNA, 19 bp, Artificial Sequence
  Description of Artificial Sequence: Chemically synthesized oligonucleotide
cactgcaggcatgctgaac

SEQ ID NO: 10976 - DNA, 19 bp, Artificial Sequence
  Description of Artificial Sequence: Chemically synthesized oligonucleotide
gttcagcatgcctgcagtg

SEQ ID NO: 10977 - DNA, 19 bp, Artificial Sequence
  Description of Artificial Sequence: Chemically synthesized oligonucleotide
actgcaggcatgctgaaca

SEQ ID NO: 10978 - DNA, 19 bp, Artificial Sequence
  Description of Artificial Sequence: Chemically synthesized oligonucleotide
tgttcagcatgcctgcagt

SEQ ID NO: 10979 - DNA, 19 bp, Artificial Sequence
  Description of Artificial Sequence: Chemically synthesized oligonucleotide
ctgcaggcatgctgaacaa

SEQ ID NO: 10980 - DNA, 19 bp, Artificial Sequence
  Description of Artificial Sequence: Chemically synthesized oligonucleotide
ttgttcagcatgcctgcag

SEQ ID NO: 10981 - DNA, 19 bp, Artificial Sequence
  Description of Artificial Sequence: Chemically synthesized oligonucleotide
tgcaggcatgctgaacaag

SEQ ID NO: 10982 - DNA, 19 bp, Artificial Sequence
  Description of Artificial Sequence: Chemically synthesized oligonucleotide
cttgttcagcatgcctgca

SEQ ID NO: 10983 - DNA, 19 bp, Artificial Sequence
  Description of Artificial Sequence: Chemically synthesized oligonucleotide
gcaggcatgctgaacaagg

SEQ ID NO: 10984 - DNA, 19 bp, Artificial Sequence
  Description of Artificial Sequence: Chemically synthesized oligonucleotide
ccttgttcagcatgcctgc

SEQ ID NO: 10985 - DNA, 19 bp, Artificial Sequence
  Description of Artificial Sequence: Chemically synthesized oligonucleotide
caggcatgctgaacaaggg

SEQ ID NO: 10986 - DNA, 19 bp, Artificial Sequence
  Description of Artificial Sequence: Chemically synthesized oligonucleotide
cccttgttcagcatgcctg

SEQ ID NO: 10987 - DNA, 19 bp, Artificial Sequence
  Description of Artificial Sequence: Chemically synthesized oligonucleotide
aggcatgctgaacaagggg

SEQ ID NO: 10988 - DNA, 19 bp, Artificial Sequence
  Description of Artificial Sequence: Chemically synthesized oligonucleotide
ccccttgttcagcatgcct

SEQ ID NO: 10989 - DNA, 19 bp, Artificial Sequence
  Description of Artificial Sequence: Chemically synthesized oligonucleotide
ggcatgctgaacaaggggc

SEQ ID NO: 10990 - DNA, 19 bp, Artificial Sequence
  Description of Artificial Sequence: Chemically synthesized oligonucleotide
gccccttgttcagcatgcc

SEQ ID NO: 10991 - DNA, 19 bp, Artificial Sequence
  Description of Artificial Sequence: Chemically synthesized oligonucleotide
gcatgctgaacaaggggcc

SEQ ID NO: 10992 - DNA, 19 bp, Artificial Sequence
  Description of Artificial Sequence: Chemically synthesized oligonucleotide
ggccccttgttcagcatgc

SEQ ID NO: 10993 - DNA, 19 bp, Artificial Sequence
  Description of Artificial Sequence: Chemically synthesized oligonucleotide
catgctgaacaaggggcct

SEQ ID NO: 10994 - DNA, 19 bp, Artificial Sequence
  Description of Artificial Sequence: Chemically synthesized oligonucleotide
aggccccttgttcagcatg

SEQ ID NO: 10995 - DNA, 19 bp, Artificial Sequence
  Description of Artificial Sequence: Chemically synthesized oligonucleotide
atgctgaacaaggggcctc

SEQ ID NO: 10996 - DNA, 19 bp, Artificial Sequence
  Description of Artificial Sequence: Chemically synthesized oligonucleotide
gaggccccttgttcagcat

SEQ ID NO: 10997 - DNA, 19 bp, Artificial Sequence
  Description of Artificial Sequence: Chemically synthesized oligonucleotide
tgctgaacaaggggcctcc

SEQ ID NO: 10998 - DNA, 19 bp, Artificial Sequence
  Description of Artificial Sequence: Chemically synthesized oligonucleotide
ggaggccccttgttcagca

SEQ ID NO: 10999 - DNA, 19 bp, Artificial Sequence
  Description of Artificial Sequence: Chemically synthesized oligonucleotide
gctgaacaaggggcctcca

SEQ ID NO: 11000 - DNA, 19 bp, Artificial Sequence
  Description of Artificial Sequence: Chemically synthesized oligonucleotide
tggaggccccttgttcagc

SEQ ID NO: 11001 - DNA, 19 bp, Artificial Sequence
  Description of Artificial Sequence: Chemically synthesized oligonucleotide
ctgaacaaggggcctccaa

SEQ ID NO: 11002 - DNA, 19 bp, Artificial Sequence
  Description of Artificial Sequence: Chemically synthesized oligonucleotide
ttggaggccccttgttcag

SEQ ID NO: 11003 - DNA, 19 bp, Artificial Sequence
  Description of Artificial Sequence: Chemically synthesized oligonucleotide
tgaacaaggggcctccaac

SEQ ID NO: 11004 - DNA, 19 bp, Artificial Sequence
  Description of Artificial Sequence: Chemically synthesized oligonucleotide
gttggaggccccttgttca

SEQ ID NO: 11005 - DNA, 19 bp, Artificial Sequence
  Description of Artificial Sequence: Chemically synthesized oligonucleotide
gaacaaggggcctccaacc

SEQ ID NO: 11006 - DNA, 19 bp, Artificial Sequence
  Description of Artificial Sequence: Chemically synthesized oligonucleotide
ggttggaggccccttgttc

SEQ ID NO: 11007 - DNA, 19 bp, Artificial Sequence
  Description of Artificial Sequence: Chemically synthesized oligonucleotide
aacaaggggcctccaacct

SEQ ID NO: 11008 - DNA, 19 bp, Artificial Sequence
  Description of Artificial Sequence: Chemically synthesized oligonucleotide
aggttggaggccccttgtt

SEQ ID NO: 11009 - DNA, 19 bp, Artificial Sequence
  Description of Artificial Sequence: Chemically synthesized oligonucleotide
acaaggggcctccaacctt

SEQ ID NO: 11010 - DNA, 19 bp, Artificial Sequence
  Description of Artificial Sequence: Chemically synthesized oligonucleotide
aaggttggaggccccttgt

SEQ ID NO: 11011 - DNA, 19 bp, Artificial Sequence
  Description of Artificial Sequence: Chemically synthesized oligonucleotide
caaggggcctccaaccttc

SEQ ID NO: 11012 - DNA, 19 bp, Artificial Sequence
  Description of Artificial Sequence: Chemically synthesized oligonucleotide
gaaggttggaggccccttg

SEQ ID NO: 11013 - DNA, 19 bp, Artificial Sequence
  Description of Artificial Sequence: Chemically synthesized oligonucleotide
aaggggcctccaaccttct

SEQ ID NO: 11014 - DNA, 19 bp, Artificial Sequence
  Description of Artificial Sequence: Chemically synthesized oligonucleotide
agaaggttggaggcccctt

SEQ ID NO: 11015 - DNA, 19 bp, Artificial Sequence
  Description of Artificial Sequence: Chemically synthesized oligonucleotide
aggggcctccaaccttctg

SEQ ID NO: 11016 - DNA, 19 bp, Artificial Sequence
  Description of Artificial Sequence: Chemically synthesized oligonucleotide
cagaaggttggaggcccct

SEQ ID NO: 11017 - DNA, 19 bp, Artificial Sequence
  Description of Artificial Sequence: Chemically synthesized oligonucleotide
ggggcctccaaccttctgc

SEQ ID NO: 11018 - DNA, 19 bp, Artificial Sequence
  Description of Artificial Sequence: Chemically synthesized oligonucleotide
gcagaaggttggaggcccc

SEQ ID NO: 11019 - DNA, 19 bp, Artificial Sequence
  Description of Artificial Sequence: Chemically synthesized oligonucleotide
gggcctccaaccttctgcc

SEQ ID NO: 11020 - DNA, 19 bp, Artificial Sequence
  Description of Artificial Sequence: Chemically synthesized oligonucleotide
ggcagaaggttggaggccc

SEQ ID NO: 11021 - DNA, 19 bp, Artificial Sequence
  Description of Artificial Sequence: Chemically synthesized oligonucleotide
ggcctccaaccttctgccc

SEQ ID NO: 11022 - DNA, 19 bp, Artificial Sequence
  Description of Artificial Sequence: Chemically synthesized oligonucleotide
gggcagaaggttggaggcc

SEQ ID NO: 11023 - DNA, 19 bp, Artificial Sequence
  Description of Artificial Sequence: Chemically synthesized oligonucleotide
gcctccaaccttctgccct

SEQ ID NO: 11024 - DNA, 19 bp, Artificial Sequence
  Description of Artificial Sequence: Chemically synthesized oligonucleotide
agggcagaaggttggaggc

SEQ ID NO: 11025 - DNA, 19 bp, Artificial Sequence
  Description of Artificial Sequence: Chemically synthesized oligonucleotide
cctccaaccttctgccctc

SEQ ID NO: 11026 - DNA, 19 bp, Artificial Sequence
  Description of Artificial Sequence: Chemically synthesized oligonucleotide
gagggcagaaggttggagg

SEQ ID NO: 11027 - DNA, 19 bp, Artificial Sequence
  Description of Artificial Sequence: Chemically synthesized oligonucleotide
ctccaaccttctgccctcc

SEQ ID NO: 11028 - DNA, 19 bp, Artificial Sequence
  Description of Artificial Sequence: Chemically synthesized oligonucleotide
ggagggcagaaggttggag

SEQ ID NO: 11029 - DNA, 19 bp, Artificial Sequence
  Description of Artificial Sequence: Chemically synthesized oligonucleotide
tccaaccttctgccctcct

SEQ ID NO: 11030 - DNA, 19 bp, Artificial Sequence
  Description of Artificial Sequence: Chemically synthesized oligonucleotide
aggagggcagaaggttgga

SEQ ID NO: 11031 - DNA, 19 bp, Artificial Sequence
  Description of Artificial Sequence: Chemically synthesized oligonucleotide
ccaaccttctgccctcctg

SEQ ID NO: 11032 - DNA, 19 bp, Artificial Sequence
  Description of Artificial Sequence: Chemically synthesized oligonucleotide
caggagggcagaaggttgg

SEQ ID NO: 11033 - DNA, 19 bp, Artificial Sequence
  Description of Artificial Sequence: Chemically synthesized oligonucleotide
caaccttctgccctcctgc

SEQ ID NO: 11034 - DNA, 19 bp, Artificial Sequence
  Description of Artificial Sequence: Chemically synthesized oligonucleotide
gcaggagggcagaaggttg

SEQ ID NO: 11035 - DNA, 19 bp, Artificial Sequence
  Description of Artificial Sequence: Chemically synthesized oligonucleotide
aaccttctgccctcctgcc

SEQ ID NO: 11036 - DNA, 19 bp, Artificial Sequence
  Description of Artificial Sequence: Chemically synthesized oligonucleotide
ggcaggagggcagaaggtt

SEQ ID NO: 11037 - DNA, 19 bp, Artificial Sequence
  Description of Artificial Sequence: Chemically synthesized oligonucleotide
accttctgccctcctgcca

SEQ ID NO: 11038 - DNA, 19 bp, Artificial Sequence
  Description of Artificial Sequence: Chemically synthesized oligonucleotide
tggcaggagggcagaaggt

SEQ ID NO: 11039 - DNA, 19 bp, Artificial Sequence
  Description of Artificial Sequence: Chemically synthesized oligonucleotide
ccttctgccctcctgccaa

SEQ ID NO: 11040 - DNA, 19 bp, Artificial Sequence
  Description of Artificial Sequence: Chemically synthesized oligonucleotide
ttggcaggagggcagaagg

SEQ ID NO: 11041 - DNA, 19 bp, Artificial Sequence
  Description of Artificial Sequence: Chemically synthesized oligonucleotide
cttctgccctcctgccaaa

SEQ ID NO: 11042 - DNA, 19 bp, Artificial Sequence
  Description of Artificial Sequence: Chemically synthesized oligonucleotide
tttggcaggagggcagaag

SEQ ID NO: 11043 - DNA, 19 bp, Artificial Sequence
  Description of Artificial Sequence: Chemically synthesized oligonucleotide
ttctgccctcctgccaaaa

SEQ ID NO: 11044 - DNA, 19 bp, Artificial Sequence
  Description of Artificial Sequence: Chemically synthesized oligonucleotide
ttttggcaggagggcagaa

SEQ ID NO: 11045 - DNA, 19 bp, Artificial Sequence
  Description of Artificial Sequence: Chemically synthesized oligonucleotide
tctgccctcctgccaaaag

SEQ ID NO: 11046 - DNA, 19 bp, Artificial Sequence
  Description of Artificial Sequence: Chemically synthesized oligonucleotide
cttttggcaggagggcaga

SEQ ID NO: 11047 - DNA, 19 bp, Artificial Sequence
  Description of Artificial Sequence: Chemically synthesized oligonucleotide
ctgccctcctgccaaaaga

SEQ ID NO: 11048 - DNA, 19 bp, Artificial Sequence
  Description of Artificial Sequence: Chemically synthesized oligonucleotide
tcttttggcaggagggcag

SEQ ID NO: 11049 - DNA, 19 bp, Artificial Sequence
  Description of Artificial Sequence: Chemically synthesized oligonucleotide
tgccctcctgccaaaagat

SEQ ID NO: 11050 - DNA, 19 bp, Artificial Sequence
  Description of Artificial Sequence: Chemically synthesized oligonucleotide
atcttttggcaggagggca

SEQ ID NO: 11051 - DNA, 19 bp, Artificial Sequence
  Description of Artificial Sequence: Chemically synthesized oligonucleotide
gccctcctgccaaaagatc

SEQ ID NO: 11052 - DNA, 19 bp, Artificial Sequence
  Description of Artificial Sequence: Chemically synthesized oligonucleotide
gatcttttggcaggagggc

SEQ ID NO: 11053 - DNA, 19 bp, Artificial Sequence
  Description of Artificial Sequence: Chemically synthesized oligonucleotide
ccctcctgccaaaagatct

SEQ ID NO: 11054 - DNA, 19 bp, Artificial Sequence
  Description of Artificial Sequence: Chemically synthesized oligonucleotide
agatcttttggcaggaggg

SEQ ID NO: 11055 - DNA, 19 bp, Artificial Sequence
  Description of Artificial Sequence: Chemically synthesized oligonucleotide
cctcctgccaaaagatctg

SEQ ID NO: 11056 - DNA, 19 bp, Artificial Sequence
  Description of Artificial Sequence: Chemically synthesized oligonucleotide
cagatcttttggcaggagg

SEQ ID NO: 11057 - DNA, 19 bp, Artificial Sequence
  Description of Artificial Sequence: Chemically synthesized oligonucleotide
ctcctgccaaaagatctgg

SEQ ID NO: 11058 - DNA, 19 bp, Artificial Sequence
  Description of Artificial Sequence: Chemically synthesized oligonucleotide
ccagatcttttggcaggag

SEQ ID NO: 11059 - DNA, 19 bp, Artificial Sequence
  Description of Artificial Sequence: Chemically synthesized oligonucleotide
tcctgccaaaagatctggg

SEQ ID NO: 11060 - DNA, 19 bp, Artificial Sequence
  Description of Artificial Sequence: Chemically synthesized oligonucleotide
cccagatcttttggcagga

SEQ ID NO: 11061 - DNA, 19 bp, Artificial Sequence
  Description of Artificial Sequence: Chemically synthesized oligonucleotide
cctgccaaaagatctgggg

SEQ ID NO: 11062 - DNA, 19 bp, Artificial Sequence
  Description of Artificial Sequence: Chemically synthesized oligonucleotide
ccccagatcttttggcagg

SEQ ID NO: 11063 - DNA, 19 bp, Artificial Sequence
  Description of Artificial Sequence: Chemically synthesized oligonucleotide
ctgccaaaagatctgggga

SEQ ID NO: 11064 - DNA, 19 bp, Artificial Sequence
  Description of Artificial Sequence: Chemically synthesized oligonucleotide
tccccagatcttttggcag

SEQ ID NO: 11065 - DNA, 19 bp, Artificial Sequence
  Description of Artificial Sequence: Chemically synthesized oligonucleotide
tgccaaaagatctggggag

SEQ ID NO: 11066 - DNA, 19 bp, Artificial Sequence
  Description of Artificial Sequence: Chemically synthesized oligonucleotide
ctccccagatcttttggca

SEQ ID NO: 11067 - DNA, 19 bp, Artificial Sequence
  Description of Artificial Sequence: Chemically synthesized oligonucleotide
gccaaaagatctggggagt

SEQ ID NO: 11068 - DNA, 19 bp, Artificial Sequence
  Description of Artificial Sequence: Chemically synthesized oligonucleotide
actccccagatcttttggc

SEQ ID NO: 11069 - DNA, 19 bp, Artificial Sequence
  Description of Artificial Sequence: Chemically synthesized oligonucleotide
ccaaaagatctggggagtg

SEQ ID NO: 11070 - DNA, 19 bp, Artificial Sequence
  Description of Artificial Sequence: Chemically synthesized oligonucleotide
cactccccagatcttttgg

SEQ ID NO: 11071 - DNA, 19 bp, Artificial Sequence
  Description of Artificial Sequence: Chemically synthesized oligonucleotide
caaaagatctggggagtgt

SEQ ID NO: 11072 - DNA, 19 bp, Artificial Sequence
  Description of Artificial Sequence: Chemically synthesized oligonucleotide
acactccccagatcttttg

SEQ ID NO: 11073 - DNA, 19 bp, Artificial Sequence
  Description of Artificial Sequence: Chemically synthesized oligonucleotide
aaaagatctggggagtgtg

SEQ ID NO: 11074 - DNA, 19 bp, Artificial Sequence
  Description of Artificial Sequence: Chemically synthesized oligonucleotide
cacactccccagatctttt

SEQ ID NO: 11075 - DNA, 19 bp, Artificial Sequence
  Description of Artificial Sequence: Chemically synthesized oligonucleotide
aaagatctggggagtgtga

SEQ ID NO: 11076 - DNA, 19 bp, Artificial Sequence
  Description of Artificial Sequence: Chemically synthesized oligonucleotide
tcacactccccagatcttt

SEQ ID NO: 11077 - DNA, 19 bp, Artificial Sequence
  Description of Artificial Sequence: Chemically synthesized oligonucleotide
aagatctggggagtgtgag

SEQ ID NO: 11078 - DNA, 19 bp, Artificial Sequence
  Description of Artificial Sequence: Chemically synthesized oligonucleotide
ctcacactccccagatctt

SEQ ID NO: 11079 - DNA, 19 bp, Artificial Sequence
  Description of Artificial Sequence: Chemically synthesized oligonucleotide
agatctggggagtgtgagg

SEQ ID NO: 11080 - DNA, 19 bp, Artificial Sequence
  Description of Artificial Sequence: Chemically synthesized oligonucleotide
cctcacactccccagatct

SEQ ID NO: 11081 - DNA, 19 bp, Artificial Sequence
  Description of Artificial Sequence: Chemically synthesized oligonucleotide
gatctggggagtgtgagga

SEQ ID NO: 11082 - DNA, 19 bp, Artificial Sequence
  Description of Artificial Sequence: Chemically synthesized oligonucleotide
tcctcacactccccagatc

SEQ ID NO: 11083 - DNA, 19 bp, Artificial Sequence
  Description of Artificial Sequence: Chemically synthesized oligonucleotide
atctggggagtgtgaggag

SEQ ID NO: 11084 - DNA, 19 bp, Artificial Sequence
  Description of Artificial Sequence: Chemically synthesized oligonucleotide
ctcctcacactccccagat

SEQ ID NO: 11085 - DNA, 19 bp, Artificial Sequence
  Description of Artificial Sequence: Chemically synthesized oligonucleotide
tctggggagtgtgaggaga

SEQ ID NO: 11086 - DNA, 19 bp, Artificial Sequence
  Description of Artificial Sequence: Chemically synthesized oligonucleotide
tctcctcacactccccaga

SEQ ID NO: 11087 - DNA, 19 bp, Artificial Sequence
  Description of Artificial Sequence: Chemically synthesized oligonucleotide
ctggggagtgtgaggagag

SEQ ID NO: 11088 - DNA, 19 bp, Artificial Sequence
  Description of Artificial Sequence: Chemically synthesized oligonucleotide
ctctcctcacactccccag

SEQ ID NO: 11089 - DNA, 19 bp, Artificial Sequence
  Description of Artificial Sequence: Chemically synthesized oligonucleotide
tggggagtgtgaggagagg

SEQ ID NO: 11090 - DNA, 19 bp, Artificial Sequence
  Description of Artificial Sequence: Chemically synthesized oligonucleotide
cctctcctcacactcccca

SEQ ID NO: 11091 - DNA, 19 bp, Artificial Sequence
  Description of Artificial Sequence: Chemically synthesized oligonucleotide
ggggagtgtgaggagaggg

SEQ ID NO: 11092 - DNA, 19 bp, Artificial Sequence
  Description of Artificial Sequence: Chemically synthesized oligonucleotide
ccctctcctcacactcccc

SEQ ID NO: 11093 - DNA, 19 bp, Artificial Sequence
  Description of Artificial Sequence: Chemically synthesized oligonucleotide
gggagtgtgaggagagggt

SEQ ID NO: 11094 - DNA, 19 bp, Artificial Sequence
  Description of Artificial Sequence: Chemically synthesized oligonucleotide
accctctcctcacactccc

SEQ ID NO: 11095 - DNA, 19 bp, Artificial Sequence
  Description of Artificial Sequence: Chemically synthesized oligonucleotide
ggagtgtgaggagagggtg

SEQ ID NO: 11096 - DNA, 19 bp, Artificial Sequence
  Description of Artificial Sequence: Chemically synthesized oligonucleotide
caccctctcctcacactcc

SEQ ID NO: 11097 - DNA, 19 bp, Artificial Sequence
  Description of Artificial Sequence: Chemically synthesized oligonucleotide
gagtgtgaggagagggtgg

SEQ ID NO: 11098 - DNA, 19 bp, Artificial Sequence
  Description of Artificial Sequence: Chemically synthesized oligonucleotide
ccaccctctcctcacactc

SEQ ID NO: 11099 - DNA, 19 bp, Artificial Sequence
  Description of Artificial Sequence: Chemically synthesized oligonucleotide
agtgtgaggagagggtggc

SEQ ID NO: 11100 - DNA, 19 bp, Artificial Sequence
  Description of Artificial Sequence: Chemically synthesized oligonucleotide
gccaccctctcctcacact

SEQ ID NO: 11101 - DNA, 19 bp, Artificial Sequence
  Description of Artificial Sequence: Chemically synthesized oligonucleotide
gtgtgaggagagggtggca

SEQ ID NO: 11102 - DNA, 19 bp, Artificial Sequence
  Description of Artificial Sequence: Chemically synthesized oligonucleotide
tgccaccctctcctcacac

SEQ ID NO: 11103 - DNA, 19 bp, Artificial Sequence
  Description of Artificial Sequence: Chemically synthesized oligonucleotide
tgtgaggagagggtggcat

SEQ ID NO: 11104 - DNA, 19 bp, Artificial Sequence
  Description of Artificial Sequence: Chemically synthesized oligonucleotide
atgccaccctctcctcaca

SEQ ID NO: 11105 - DNA, 19 bp, Artificial Sequence
  Description of Artificial Sequence: Chemically synthesized oligonucleotide
gtgaggagagggtggcatc

SEQ ID NO: 11106 - DNA, 19 bp, Artificial Sequence
  Description of Artificial Sequence: Chemically synthesized oligonucleotide
gatgccaccctctcctcac

SEQ ID NO: 11107 - DNA, 19 bp, Artificial Sequence
  Description of Artificial Sequence: Chemically synthesized oligonucleotide
tgaggagagggtggcatca

SEQ ID NO: 11108 - DNA, 19 bp, Artificial Sequence
  Description of Artificial Sequence: Chemically synthesized oligonucleotide
tgatgccaccctctcctca

SEQ ID NO: 11109 - DNA, 19 bp, Artificial Sequence
  Description of Artificial Sequence: Chemically synthesized oligonucleotide
gaggagagggtggcatcag

SEQ ID NO: 11110 - DNA, 19 bp, Artificial Sequence
  Description of Artificial Sequence: Chemically synthesized oligonucleotide
ctgatgccaccctctcctc

SEQ ID NO: 11111 - DNA, 19 bp, Artificial Sequence
  Description of Artificial Sequence: Chemically synthesized oligonucleotide
aggagagggtggcatcagg

SEQ ID NO: 11112 - DNA, 19 bp, Artificial Sequence
  Description of Artificial Sequence: Chemically synthesized oligonucleotide
cctgatgccaccctctcct

SEQ ID NO: 11113 - DNA, 19 bp, Artificial Sequence
  Description of Artificial Sequence: Chemically synthesized oligonucleotide
ggagagggtggcatcagga

SEQ ID NO: 11114 - DNA, 19 bp, Artificial Sequence
  Description of Artificial Sequence: Chemically synthesized oligonucleotide
tcctgatgccaccctctcc

SEQ ID NO: 11115 - DNA, 19 bp, Artificial Sequence
  Description of Artificial Sequence: Chemically synthesized oligonucleotide
gagagggtggcatcaggag

SEQ ID NO: 11116 - DNA, 19 bp, Artificial Sequence
  Description of Artificial Sequence: Chemically synthesized oligonucleotide
ctcctgatgccaccctctc

SEQ ID NO: 11117 - DNA, 19 bp, Artificial Sequence
  Description of Artificial Sequence: Chemically synthesized oligonucleotide
agagggtggcatcaggagc

SEQ ID NO: 11118 - DNA, 19 bp, Artificial Sequence
  Description of Artificial Sequence: Chemically synthesized oligonucleotide
gctcctgatgccaccctct

SEQ ID NO: 11119 - DNA, 19 bp, Artificial Sequence
  Description of Artificial Sequence: Chemically synthesized oligonucleotide
gagggtggcatcaggagct

SEQ ID NO: 11120 - DNA, 19 bp, Artificial Sequence
  Description of Artificial Sequence: Chemically synthesized oligonucleotide
agctcctgatgccaccctc

SEQ ID NO: 11121 - DNA, 19 bp, Artificial Sequence
  Description of Artificial Sequence: Chemically synthesized oligonucleotide
agggtggcatcaggagctg

SEQ ID NO: 11122 - DNA, 19 bp, Artificial Sequence
  Description of Artificial Sequence: Chemically synthesized oligonucleotide
cagctcctgatgccaccct

SEQ ID NO: 11123 - DNA, 19 bp, Artificial Sequence
  Description of Artificial Sequence: Chemically synthesized oligonucleotide
gggtggcatcaggagctgc

SEQ ID NO: 11124 - DNA, 19 bp, Artificial Sequence
  Description of Artificial Sequence: Chemically synthesized oligonucleotide
gcagctcctgatgccaccc

SEQ ID NO: 11125 - DNA, 19 bp, Artificial Sequence
  Description of Artificial Sequence: Chemically synthesized oligonucleotide
ggtggcatcaggagctgct

SEQ ID NO: 11126 - DNA, 19 bp, Artificial Sequence
  Description of Artificial Sequence: Chemically synthesized oligonucleotide
agcagctcctgatgccacc

SEQ ID NO: 11127 - DNA, 19 bp, Artificial Sequence
  Description of Artificial Sequence: Chemically synthesized oligonucleotide
gtggcatcaggagctgctc

SEQ ID NO: 11128 - DNA, 19 bp, Artificial Sequence
  Description of Artificial Sequence: Chemically synthesized oligonucleotide
gagcagctcctgatgccac

SEQ ID NO: 11129 - DNA, 19 bp, Artificial Sequence
  Description of Artificial Sequence: Chemically synthesized oligonucleotide
tggcatcaggagctgctca

SEQ ID NO: 11130 - DNA, 19 bp, Artificial Sequence
  Description of Artificial Sequence: Chemically synthesized oligonucleotide
tgagcagctcctgatgcca

SEQ ID NO: 11131 - DNA, 19 bp, Artificial Sequence
  Description of Artificial Sequence: Chemically synthesized oligonucleotide
ggcatcaggagctgctcag

SEQ ID NO: 11132 - DNA, 19 bp, Artificial Sequence
  Description of Artificial Sequence: Chemically synthesized oligonucleotide
ctgagcagctcctgatgcc

SEQ ID NO: 11133 - DNA, 19 bp, Artificial Sequence
  Description of Artificial Sequence: Chemically synthesized oligonucleotide
gcatcaggagctgctcagg

SEQ ID NO: 11134 - DNA, 19 bp, Artificial Sequence
  Description of Artificial Sequence: Chemically synthesized oligonucleotide
cctgagcagctcctgatgc

SEQ ID NO: 11135 - DNA, 19 bp, Artificial Sequence
  Description of Artificial Sequence: Chemically synthesized oligonucleotide
catcaggagctgctcaggc

SEQ ID NO: 11136 - DNA, 19 bp, Artificial Sequence
  Description of Artificial Sequence: Chemically synthesized oligonucleotide
gcctgagcagctcctgatg

SEQ ID NO: 11137 - DNA, 19 bp, Artificial Sequence
  Description of Artificial Sequence: Chemically synthesized oligonucleotide
atcaggagctgctcaggct

SEQ ID NO: 11138 - DNA, 19 bp, Artificial Sequence
  Description of Artificial Sequence: Chemically synthesized oligonucleotide
agcctgagcagctcctgat

SEQ ID NO: 11139 - DNA, 19 bp, Artificial Sequence
  Description of Artificial Sequence: Chemically synthesized oligonucleotide
tcaggagctgctcaggctt

SEQ ID NO: 11140 - DNA, 19 bp, Artificial Sequence
  Description of Artificial Sequence: Chemically synthesized oligonucleotide
aagcctgagcagctcctga

SEQ ID NO: 11141 - DNA, 19 bp, Artificial Sequence
  Description of Artificial Sequence: Chemically synthesized oligonucleotide
caggagctgctcaggcttg

SEQ ID NO: 11142 - DNA, 19 bp, Artificial Sequence
  Description of Artificial Sequence: Chemically synthesized oligonucleotide
caagcctgagcagctcctg

SEQ ID NO: 11143 - DNA, 19 bp, Artificial Sequence
  Description of Artificial Sequence: Chemically synthesized oligonucleotide
aggagctgctcaggcttgg

SEQ ID NO: 11144 - DNA, 19 bp, Artificial Sequence
  Description of Artificial Sequence: Chemically synthesized oligonucleotide
ccaagcctgagcagctcct

SEQ ID NO: 11145 - DNA, 19 bp, Artificial Sequence
  Description of Artificial Sequence: Chemically synthesized oligonucleotide
ggagctgctcaggcttggc

SEQ ID NO: 11146 - DNA, 19 bp, Artificial Sequence
  Description of Artificial Sequence: Chemically synthesized oligonucleotide
gccaagcctgagcagctcc

SEQ ID NO: 11147 - DNA, 19 bp, Artificial Sequence
  Description of Artificial Sequence: Chemically synthesized oligonucleotide
gagctgctcaggcttggcg

SEQ ID NO: 11148 - DNA, 19 bp, Artificial Sequence
  Description of Artificial Sequence: Chemically synthesized oligonucleotide
cgccaagcctgagcagctc

SEQ ID NO: 11149 - DNA, 19 bp, Artificial Sequence
  Description of Artificial Sequence: Chemically synthesized oligonucleotide
agctgctcaggcttggcgg

SEQ ID NO: 11150 - DNA, 19 bp, Artificial Sequence
  Description of Artificial Sequence: Chemically synthesized oligonucleotide
ccgccaagcctgagcagct

SEQ ID NO: 11151 - DNA, 19 bp, Artificial Sequence
  Description of Artificial Sequence: Chemically synthesized oligonucleotide
gctgctcaggcttggcgga

SEQ ID NO: 11152 - DNA, 19 bp, Artificial Sequence
  Description of Artificial Sequence: Chemically synthesized oligonucleotide
tccgccaagcctgagcagc

SEQ ID NO: 11153 - DNA, 19 bp, Artificial Sequence
  Description of Artificial Sequence: Chemically synthesized oligonucleotide
ctgctcaggcttggcggag

SEQ ID NO: 11154 - DNA, 19 bp, Artificial Sequence
  Description of Artificial Sequence: Chemically synthesized oligonucleotide
ctccgccaagcctgagcag

SEQ ID NO: 11155 - DNA, 19 bp, Artificial Sequence
  Description of Artificial Sequence: Chemically synthesized oligonucleotide
tgctcaggcttggcggagg

SEQ ID NO: 11156 - DNA, 19 bp, Artificial Sequence
  Description of Artificial Sequence: Chemically synthesized oligonucleotide
cctccgccaagcctgagca

SEQ ID NO: 11157 - DNA, 19 bp, Artificial Sequence
  Description of Artificial Sequence: Chemically synthesized oligonucleotide
gctcaggcttggcggaggg

SEQ ID NO: 11158 - DNA, 19 bp, Artificial Sequence
  Description of Artificial Sequence: Chemically synthesized oligonucleotide
ccctccgccaagcctgagc

SEQ ID NO: 11159 - DNA, 19 bp, Artificial Sequence
  Description of Artificial Sequence: Chemically synthesized oligonucleotide
ctcaggcttggcggaggga

SEQ ID NO: 11160 - DNA, 19 bp, Artificial Sequence
  Description of Artificial Sequence: Chemically synthesized oligonucleotide
tccctccgccaagcctgag

SEQ ID NO: 11161 - DNA, 19 bp, Artificial Sequence
  Description of Artificial Sequence: Chemically synthesized oligonucleotide
tcaggcttggcggagggag

SEQ ID NO: 11162 - DNA, 19 bp, Artificial Sequence
  Description of Artificial Sequence: Chemically synthesized oligonucleotide
ctccctccgccaagcctga

SEQ ID NO: 11163 - DNA, 19 bp, Artificial Sequence
  Description of Artificial Sequence: Chemically synthesized oligonucleotide
caggcttggcggagggagc

SEQ ID NO: 11164 - DNA, 19 bp, Artificial Sequence
  Description of Artificial Sequence: Chemically synthesized oligonucleotide
gctccctccgccaagcctg

SEQ ID NO: 11165 - DNA, 19 bp, Artificial Sequence
  Description of Artificial Sequence: Chemically synthesized oligonucleotide
aggcttggcggagggagcg

SEQ ID NO: 11166 - DNA, 19 bp, Artificial Sequence
  Description of Artificial Sequence: Chemically synthesized oligonucleotide
cgctccctccgccaagcct

SEQ ID NO: 11167 - DNA, 19 bp, Artificial Sequence
  Description of Artificial Sequence: Chemically synthesized oligonucleotide
ggcttggcggagggagcgg

SEQ ID NO: 11168 - DNA, 19 bp, Artificial Sequence
  Description of Artificial Sequence: Chemically synthesized oligonucleotide
ccgctccctccgccaagcc

SEQ ID NO: 11169 - DNA, 19 bp, Artificial Sequence
  Description of Artificial Sequence: Chemically synthesized oligonucleotide
gcttggcggagggagcggc

SEQ ID NO: 11170 - DNA, 19 bp, Artificial Sequence
  Description of Artificial Sequence: Chemically synthesized oligonucleotide
gccgctccctccgccaagc

SEQ ID NO: 11171 - DNA, 19 bp, Artificial Sequence
  Description of Artificial Sequence: Chemically synthesized oligonucleotide
cttggcggagggagcggca

SEQ ID NO: 11172 - DNA, 19 bp, Artificial Sequence
  Description of Artificial Sequence: Chemically synthesized oligonucleotide
tgccgctccctccgccaag

SEQ ID NO: 11173 - DNA, 19 bp, Artificial Sequence
  Description of Artificial Sequence: Chemically synthesized oligonucleotide
ttggcggagggagcggcat

SEQ ID NO: 11174 - DNA, 19 bp, Artificial Sequence
  Description of Artificial Sequence: Chemically synthesized oligonucleotide
atgccgctccctccgccaa

SEQ ID NO: 11175 - DNA, 19 bp, Artificial Sequence
  Description of Artificial Sequence: Chemically synthesized oligonucleotide
tggcggagggagcggcatg

SEQ ID NO: 11176 - DNA, 19 bp, Artificial Sequence
  Description of Artificial Sequence: Chemically synthesized oligonucleotide
catgccgctccctccgcca

SEQ ID NO: 11177 - DNA, 19 bp, Artificial Sequence
  Description of Artificial Sequence: Chemically synthesized oligonucleotide
ggcggagggagcggcatgg

SEQ ID NO: 11178 - DNA, 19 bp, Artificial Sequence
  Description of Artificial Sequence: Chemically synthesized oligonucleotide
ccatgccgctccctccgcc

SEQ ID NO: 11179 - DNA, 19 bp, Artificial Sequence
  Description of Artificial Sequence: Chemically synthesized oligonucleotide
gcggagggagcggcatggg

SEQ ID NO: 11180 - DNA, 19 bp, Artificial Sequence
  Description of Artificial Sequence: Chemically synthesized oligonucleotide
cccatgccgctccctccgc

SEQ ID NO: 11181 - DNA, 19 bp, Artificial Sequence
  Description of Artificial Sequence: Chemically synthesized oligonucleotide
cggagggagcggcatgggc

SEQ ID NO: 11182 - DNA, 19 bp, Artificial Sequence
  Description of Artificial Sequence: Chemically synthesized oligonucleotide
gcccatgccgctccctccg

SEQ ID NO: 11183 - DNA, 19 bp, Artificial Sequence
  Description of Artificial Sequence: Chemically synthesized oligonucleotide
ggagggagcggcatgggcg

SEQ ID NO: 11184 - DNA, 19 bp, Artificial Sequence
  Description of Artificial Sequence: Chemically synthesized oligonucleotide
cgcccatgccgctccctcc

SEQ ID NO: 11185 - DNA, 19 bp, Artificial Sequence
  Description of Artificial Sequence: Chemically synthesized oligonucleotide
gagggagcggcatgggcga

SEQ ID NO: 11186 - DNA, 19 bp, Artificial Sequence
  Description of Artificial Sequence: Chemically synthesized oligonucleotide
tcgcccatgccgctccctc

SEQ ID NO: 11187 - DNA, 19 bp, Artificial Sequence
  Description of Artificial Sequence: Chemically synthesized oligonucleotide
agggagcggcatgggcgat

SEQ ID NO: 11188 - DNA, 19 bp, Artificial Sequence
  Description of Artificial Sequence: Chemically synthesized oligonucleotide
atcgcccatgccgctccct

SEQ ID NO: 11189 - DNA, 19 bp, Artificial Sequence
  Description of Artificial Sequence: Chemically synthesized oligonucleotide
gggagcggcatgggcgatg

SEQ ID NO: 11190 - DNA, 19 bp, Artificial Sequence
  Description of Artificial Sequence: Chemically synthesized oligonucleotide
catcgcccatgccgctccc

SEQ ID NO: 11191 - DNA, 19 bp, Artificial Sequence
  Description of Artificial Sequence: Chemically synthesized oligonucleotide
ggagcggcatgggcgatgt

SEQ ID NO: 11192 - DNA, 19 bp, Artificial Sequence
  Description of Artificial Sequence: Chemically synthesized oligonucleotide
acatcgcccatgccgctcc

SEQ ID NO: 11193 - DNA, 19 bp, Artificial Sequence
  Description of Artificial Sequence: Chemically synthesized oligonucleotide
gagcggcatgggcgatgtc

SEQ ID NO: 11194 - DNA, 19 bp, Artificial Sequence
  Description of Artificial Sequence: Chemically synthesized oligonucleotide
gacatcgcccatgccgctc

SEQ ID NO: 11195 - DNA, 19 bp, Artificial Sequence
  Description of Artificial Sequence: Chemically synthesized oligonucleotide
agcggcatgggcgatgtca

SEQ ID NO: 11196 - DNA, 19 bp, Artificial Sequence
  Description of Artificial Sequence: Chemically synthesized oligonucleotide
tgacatcgcccatgccgct

SEQ ID NO: 11197 - DNA, 19 bp, Artificial Sequence
  Description of Artificial Sequence: Chemically synthesized oligonucleotide
gcggcatgggcgatgtcac

SEQ ID NO: 11198 - DNA, 19 bp, Artificial Sequence
  Description of Artificial Sequence: Chemically synthesized oligonucleotide
gtgacatcgcccatgccgc

SEQ ID NO: 11199 - DNA, 19 bp, Artificial Sequence
  Description of Artificial Sequence: Chemically synthesized oligonucleotide
cggcatgggcgatgtcact

SEQ ID NO: 11200 - DNA, 19 bp, Artificial Sequence
  Description of Artificial Sequence: Chemically synthesized oligonucleotide
agtgacatcgcccatgccg

SEQ ID NO: 11201 - DNA, 19 bp, Artificial Sequence
  Description of Artificial Sequence: Chemically synthesized oligonucleotide
ggcatgggcgatgtcactc

SEQ ID NO: 11202 - DNA, 19 bp, Artificial Sequence
  Description of Artificial Sequence: Chemically synthesized oligonucleotide
gagtgacatcgcccatgcc

SEQ ID NO: 11203 - DNA, 19 bp, Artificial Sequence
  Description of Artificial Sequence: Chemically synthesized oligonucleotide
gcatgggcgatgtcactca

SEQ ID NO: 11204 - DNA, 19 bp, Artificial Sequence
  Description of Artificial Sequence: Chemically synthesized oligonucleotide
tgagtgacatcgcccatgc

SEQ ID NO: 11205 - DNA, 19 bp, Artificial Sequence
  Description of Artificial Sequence: Chemically synthesized oligonucleotide
catgggcgatgtcactcag

SEQ ID NO: 11206 - DNA, 19 bp, Artificial Sequence
  Description of Artificial Sequence: Chemically synthesized oligonucleotide
ctgagtgacatcgcccatg

SEQ ID NO: 11207 - DNA, 19 bp, Artificial Sequence
  Description of Artificial Sequence: Chemically synthesized oligonucleotide
atgggcgatgtcactcagc

SEQ ID NO: 11208 - DNA, 19 bp, Artificial Sequence
  Description of Artificial Sequence: Chemically synthesized oligonucleotide
gctgagtgacatcgcccat

SEQ ID NO: 11209 - DNA, 19 bp, Artificial Sequence
  Description of Artificial Sequence: Chemically synthesized oligonucleotide
tgggcgatgtcactcagcc

SEQ ID NO: 11210 - DNA, 19 bp, Artificial Sequence
  Description of Artificial Sequence: Chemically synthesized oligonucleotide
ggctgagtgacatcgccca

SEQ ID NO: 11211 - DNA, 19 bp, Artificial Sequence
  Description of Artificial Sequence: Chemically synthesized oligonucleotide
gggcgatgtcactcagccc

SEQ ID NO: 11212 - DNA, 19 bp, Artificial Sequence
  Description of Artificial Sequence: Chemically synthesized oligonucleotide
gggctgagtgacatcgccc

SEQ ID NO: 11213 - DNA, 19 bp, Artificial Sequence
  Description of Artificial Sequence: Chemically synthesized oligonucleotide
ggcgatgtcactcagcccc

SEQ ID NO: 11214 - DNA, 19 bp, Artificial Sequence
  Description of Artificial Sequence: Chemically synthesized oligonucleotide
ggggctgagtgacatcgcc

SEQ ID NO: 11215 - DNA, 19 bp, Artificial Sequence
  Description of Artificial Sequence: Chemically synthesized oligonucleotide
gcgatgtcactcagcccct

SEQ ID NO: 11216 - DNA, 19 bp, Artificial Sequence
  Description of Artificial Sequence: Chemically synthesized oligonucleotide
aggggctgagtgacatcgc

SEQ ID NO: 11217 - DNA, 19 bp, Artificial Sequence
  Description of Artificial Sequence: Chemically synthesized oligonucleotide
cgatgtcactcagcccctt

SEQ ID NO: 11218 - DNA, 19 bp, Artificial Sequence
  Description of Artificial Sequence: Chemically synthesized oligonucleotide
aaggggctgagtgacatcg

SEQ ID NO: 11219 - DNA, 19 bp, Artificial Sequence
  Description of Artificial Sequence: Chemically synthesized oligonucleotide
gatgtcactcagccccttc

SEQ ID NO: 11220 - DNA, 19 bp, Artificial Sequence
  Description of Artificial Sequence: Chemically synthesized oligonucleotide
gaaggggctgagtgacatc

SEQ ID NO: 11221 - DNA, 19 bp, Artificial Sequence
  Description of Artificial Sequence: Chemically synthesized oligonucleotide
atgtcactcagccccttcc

SEQ ID NO: 11222 - DNA, 19 bp, Artificial Sequence
  Description of Artificial Sequence: Chemically synthesized oligonucleotide
ggaaggggctgagtgacat

SEQ ID NO: 11223 - DNA, 19 bp, Artificial Sequence
  Description of Artificial Sequence: Chemically synthesized oligonucleotide
tgtcactcagccccttccc

SEQ ID NO: 11224 - DNA, 19 bp, Artificial Sequence
  Description of Artificial Sequence: Chemically synthesized oligonucleotide
gggaaggggctgagtgaca

SEQ ID NO: 11225 - DNA, 19 bp, Artificial Sequence
  Description of Artificial Sequence: Chemically synthesized oligonucleotide
gtcactcagccccttcccg

SEQ ID NO: 11226 - DNA, 19 bp, Artificial Sequence
  Description of Artificial Sequence: Chemically synthesized oligonucleotide
cgggaaggggctgagtgac

SEQ ID NO: 11227 - DNA, 19 bp, Artificial Sequence
  Description of Artificial Sequence: Chemically synthesized oligonucleotide
tcactcagccccttcccgg

SEQ ID NO: 11228 - DNA, 19 bp, Artificial Sequence
  Description of Artificial Sequence: Chemically synthesized oligonucleotide
ccgggaaggggctgagtga

SEQ ID NO: 11229 - DNA, 19 bp, Artificial Sequence
  Description of Artificial Sequence: Chemically synthesized oligonucleotide
cactcagccccttcccggt

SEQ ID NO: 11230 - DNA, 19 bp, Artificial Sequence
  Description of Artificial Sequence: Chemically synthesized oligonucleotide
accgggaaggggctgagtg

SEQ ID NO: 11231 - DNA, 19 bp, Artificial Sequence
  Description of Artificial Sequence: Chemically synthesized oligonucleotide
actcagccccttcccggtc

SEQ ID NO: 11232 - DNA, 19 bp, Artificial Sequence
  Description of Artificial Sequence: Chemically synthesized oligonucleotide
gaccgggaaggggctgagt

SEQ ID NO: 11233 - DNA, 19 bp, Artificial Sequence
  Description of Artificial Sequence: Chemically synthesized oligonucleotide
ctcagccccttcccggtcc

SEQ ID NO: 11234 - DNA, 19 bp, Artificial Sequence
  Description of Artificial Sequence: Chemically synthesized oligonucleotide
ggaccgggaaggggctgag

SEQ ID NO: 11235 - DNA, 19 bp, Artificial Sequence
  Description of Artificial Sequence: Chemically synthesized oligonucleotide
tcagccccttcccggtccg

SEQ ID NO: 11236 - DNA, 19 bp, Artificial Sequence
  Description of Artificial Sequence: Chemically synthesized oligonucleotide
cggaccgggaaggggctga

SEQ ID NO: 11237 - DNA, 19 bp, Artificial Sequence
  Description of Artificial Sequence: Chemically synthesized oligonucleotide
cagccccttcccggtccgc

SEQ ID NO: 11238 - DNA, 19 bp, Artificial Sequence
  Description of Artificial Sequence: Chemically synthesized oligonucleotide
gcggaccgggaaggggctg

SEQ ID NO: 11239 - DNA, 19 bp, Artificial Sequence
  Description of Artificial Sequence: Chemically synthesized oligonucleotide
agccccttcccggtccgcc

SEQ ID NO: 11240 - DNA, 19 bp, Artificial Sequence
  Description of Artificial Sequence: Chemically synthesized oligonucleotide
ggcggaccgggaaggggct

SEQ ID NO: 11241 - DNA, 19 bp, Artificial Sequence
  Description of Artificial Sequence: Chemically synthesized oligonucleotide
gccccttcccggtccgccc

SEQ ID NO: 11242 - DNA, 19 bp, Artificial Sequence
  Description of Artificial Sequence: Chemically synthesized oligonucleotide
gggcggaccgggaaggggc

SEQ ID NO: 11243 - DNA, 19 bp, Artificial Sequence
  Description of Artificial Sequence: Chemically synthesized oligonucleotide
ccccttcccggtccgcccg

SEQ ID NO: 11244 - DNA, 19 bp, Artificial Sequence
  Description of Artificial Sequence: Chemically synthesized oligonucleotide
cgggcggaccgggaagggg

SEQ ID NO: 11245 - DNA, 19 bp, Artificial Sequence
  Description of Artificial Sequence: Chemically synthesized oligonucleotide
cccttcccggtccgcccgc

SEQ ID NO: 11246 - DNA, 19 bp, Artificial Sequence
  Description of Artificial Sequence: Chemically synthesized oligonucleotide
gcgggcggaccgggaaggg

SEQ ID NO: 11247 - DNA, 19 bp, Artificial Sequence
  Description of Artificial Sequence: Chemically synthesized oligonucleotide
ccttcccggtccgcccgct

SEQ ID NO: 11248 - DNA, 19 bp, Artificial Sequence
  Description of Artificial Sequence: Chemically synthesized oligonucleotide
agcgggcggaccgggaagg

SEQ ID NO: 11249 - DNA, 19 bp, Artificial Sequence
  Description of Artificial Sequence: Chemically synthesized oligonucleotide
cttcccggtccgcccgctt

SEQ ID NO: 11250 - DNA, 19 bp, Artificial Sequence
  Description of Artificial Sequence: Chemically synthesized oligonucleotide
aagcgggcggaccgggaag

SEQ ID NO: 11251 - DNA, 19 bp, Artificial Sequence
  Description of Artificial Sequence: Chemically synthesized oligonucleotide
ttcccggtccgcccgcttc

SEQ ID NO: 11252 - DNA, 19 bp, Artificial Sequence
  Description of Artificial Sequence: Chemically synthesized oligonucleotide
gaagcgggcggaccgggaa

SEQ ID NO: 11253 - DNA, 19 bp, Artificial Sequence
  Description of Artificial Sequence: Chemically synthesized oligonucleotide
tcccggtccgcccgcttcc

SEQ ID NO: 11254 - DNA, 19 bp, Artificial Sequence
  Description of Artificial Sequence: Chemically synthesized oligonucleotide
ggaagcgggcggaccggga

SEQ ID NO: 11255 - DNA, 19 bp, Artificial Sequence
  Description of Artificial Sequence: Chemically synthesized oligonucleotide
cccggtccgcccgcttccc

SEQ ID NO: 11256 - DNA, 19 bp, Artificial Sequence
  Description of Artificial Sequence: Chemically synthesized oligonucleotide
gggaagcgggcggaccggg

SEQ ID NO: 11257 - DNA, 19 bp, Artificial Sequence
  Description of Artificial Sequence: Chemically synthesized oligonucleotide
ccggtccgcccgcttccct

SEQ ID NO: 11258 - DNA, 19 bp, Artificial Sequence
  Description of Artificial Sequence: Chemically synthesized oligonucleotide
agggaagcgggcggaccgg

SEQ ID NO: 11259 - DNA, 19 bp, Artificial Sequence
  Description of Artificial Sequence: Chemically synthesized oligonucleotide
cggtccgcccgcttccctc

SEQ ID NO: 11260 - DNA, 19 bp, Artificial Sequence
  Description of Artificial Sequence: Chemically synthesized oligonucleotide
gagggaagcgggcggaccg

SEQ ID NO: 11261 - DNA, 19 bp, Artificial Sequence
  Description of Artificial Sequence: Chemically synthesized oligonucleotide
ggtccgcccgcttccctcc

SEQ ID NO: 11262 - DNA, 19 bp, Artificial Sequence
  Description of Artificial Sequence: Chemically synthesized oligonucleotide
ggagggaagcgggcggacc

SEQ ID NO: 11263 - DNA, 19 bp, Artificial Sequence
  Description of Artificial Sequence: Chemically synthesized oligonucleotide
gtccgcccgcttccctcct

SEQ ID NO: 11264 - DNA, 19 bp, Artificial Sequence
  Description of Artificial Sequence: Chemically synthesized oligonucleotide
aggagggaagcgggcggac

SEQ ID NO: 11265 - DNA, 19 bp, Artificial Sequence
  Description of Artificial Sequence: Chemically synthesized oligonucleotide
tccgcccgcttccctcctt

SEQ ID NO: 11266 - DNA, 19 bp, Artificial Sequence
  Description of Artificial Sequence: Chemically synthesized oligonucleotide
aaggagggaagcgggcgga

SEQ ID NO: 11267 - DNA, 19 bp, Artificial Sequence
  Description of Artificial Sequence: Chemically synthesized oligonucleotide
ccgcccgcttccctccttc

SEQ ID NO: 11268 - DNA, 19 bp, Artificial Sequence
  Description of Artificial Sequence: Chemically synthesized oligonucleotide
gaaggagggaagcgggcgg

SEQ ID NO: 11269 - DNA, 19 bp, Artificial Sequence
  Description of Artificial Sequence: Chemically synthesized oligonucleotide
cgcccgcttccctccttca

SEQ ID NO: 11270 - DNA, 19 bp, Artificial Sequence
  Description of Artificial Sequence: Chemically synthesized oligonucleotide
tgaaggagggaagcgggcg

SEQ ID NO: 11271 - DNA, 19 bp, Artificial Sequence
  Description of Artificial Sequence: Chemically synthesized oligonucleotide
gcccgcttccctccttcat

SEQ ID NO: 11272 - DNA, 19 bp, Artificial Sequence
  Description of Artificial Sequence: Chemically synthesized oligonucleotide
atgaaggagggaagcgggc

SEQ ID NO: 11273 - DNA, 19 bp, Artificial Sequence
  Description of Artificial Sequence: Chemically synthesized oligonucleotide
cccgcttccctccttcatg

SEQ ID NO: 11274 - DNA, 19 bp, Artificial Sequence
  Description of Artificial Sequence: Chemically synthesized oligonucleotide
catgaaggagggaagcggg

SEQ ID NO: 11275 - DNA, 19 bp, Artificial Sequence
  Description of Artificial Sequence: Chemically synthesized oligonucleotide
ccgcttccctccttcatga

SEQ ID NO: 11276 - DNA, 19 bp, Artificial Sequence
  Description of Artificial Sequence: Chemically synthesized oligonucleotide
tcatgaaggagggaagcgg

SEQ ID NO: 11277 - DNA, 19 bp, Artificial Sequence
  Description of Artificial Sequence: Chemically synthesized oligonucleotide
cgcttccctccttcatgat

SEQ ID NO: 11278 - DNA, 19 bp, Artificial Sequence
  Description of Artificial Sequence: Chemically synthesized oligonucleotide
atcatgaaggagggaagcg

SEQ ID NO: 11279 - DNA, 19 bp, Artificial Sequence
  Description of Artificial Sequence: Chemically synthesized oligonucleotide
gcttccctccttcatgatt

SEQ ID NO: 11280 - DNA, 19 bp, Artificial Sequence
  Description of Artificial Sequence: Chemically synthesized oligonucleotide
aatcatgaaggagggaagc

SEQ ID NO: 11281 - DNA, 19 bp, Artificial Sequence
  Description of Artificial Sequence: Chemically synthesized oligonucleotide
cttccctccttcatgattt

SEQ ID NO: 11282 - DNA, 19 bp, Artificial Sequence
  Description of Artificial Sequence: Chemically synthesized oligonucleotide
aaatcatgaaggagggaag

SEQ ID NO: 11283 - DNA, 19 bp, Artificial Sequence
  Description of Artificial Sequence: Chemically synthesized oligonucleotide
ttccctccttcatgatttc

SEQ ID NO: 11284 - DNA, 19 bp, Artificial Sequence
  Description of Artificial Sequence: Chemically synthesized oligonucleotide
gaaatcatgaaggagggaa

SEQ ID NO: 11285 - DNA, 19 bp, Artificial Sequence
  Description of Artificial Sequence: Chemically synthesized oligonucleotide
tccctccttcatgatttcc

SEQ ID NO: 11286 - DNA, 19 bp, Artificial Sequence
  Description of Artificial Sequence: Chemically synthesized oligonucleotide
ggaaatcatgaaggaggga

SEQ ID NO: 11287 - DNA, 19 bp, Artificial Sequence
  Description of Artificial Sequence: Chemically synthesized oligonucleotide
ccctccttcatgatttcca

SEQ ID NO: 11288 - DNA, 19 bp, Artificial Sequence
  Description of Artificial Sequence: Chemically synthesized oligonucleotide
tggaaatcatgaaggaggg

SEQ ID NO: 11289 - DNA, 19 bp, Artificial Sequence
  Description of Artificial Sequence: Chemically synthesized oligonucleotide
cctccttcatgatttccat

SEQ ID NO: 11290 - DNA, 19 bp, Artificial Sequence
  Description of Artificial Sequence: Chemically synthesized oligonucleotide
atggaaatcatgaaggagg

SEQ ID NO: 11291 - DNA, 19 bp, Artificial Sequence
  Description of Artificial Sequence: Chemically synthesized oligonucleotide
ctccttcatgatttccatt

SEQ ID NO: 11292 - DNA, 19 bp, Artificial Sequence
  Description of Artificial Sequence: Chemically synthesized oligonucleotide
aatggaaatcatgaaggag

SEQ ID NO: 11293 - DNA, 19 bp, Artificial Sequence
  Description of Artificial Sequence: Chemically synthesized oligonucleotide
tccttcatgatttccatta

SEQ ID NO: 11294 - DNA, 19 bp, Artificial Sequence
  Description of Artificial Sequence: Chemically synthesized oligonucleotide
taatggaaatcatgaagga

SEQ ID NO: 11295 - DNA, 19 bp, Artificial Sequence
  Description of Artificial Sequence: Chemically synthesized oligonucleotide
ccttcatgatttccattaa

SEQ ID NO: 11296 - DNA, 19 bp, Artificial Sequence
  Description of Artificial Sequence: Chemically synthesized oligonucleotide
ttaatggaaatcatgaagg

SEQ ID NO: 11297 - DNA, 19 bp, Artificial Sequence
  Description of Artificial Sequence: Chemically synthesized oligonucleotide
cttcatgatttccattaaa

SEQ ID NO: 11298 - DNA, 19 bp, Artificial Sequence
  Description of Artificial Sequence: Chemically synthesized oligonucleotide
tttaatggaaatcatgaag

SEQ ID NO: 11299 - DNA, 19 bp, Artificial Sequence
  Description of Artificial Sequence: Chemically synthesized oligonucleotide
ttcatgatttccattaaag

SEQ ID NO: 11300 - DNA, 19 bp, Artificial Sequence
  Description of Artificial Sequence: Chemically synthesized oligonucleotide
ctttaatggaaatcatgaa

SEQ ID NO: 11301 - DNA, 19 bp, Artificial Sequence
  Description of Artificial Sequence: Chemically synthesized oligonucleotide
tcatgatttccattaaagt

SEQ ID NO: 11302 - DNA, 19 bp, Artificial Sequence
  Description of Artificial Sequence: Chemically synthesized oligonucleotide
actttaatggaaatcatga

SEQ ID NO: 11303 - DNA, 19 bp, Artificial Sequence
  Description of Artificial Sequence: Chemically synthesized oligonucleotide
catgatttccattaaagtc

SEQ ID NO: 11304 - DNA, 19 bp, Artificial Sequence
  Description of Artificial Sequence: Chemically synthesized oligonucleotide
gactttaatggaaatcatg

SEQ ID NO: 11305 - DNA, 19 bp, Artificial Sequence
  Description of Artificial Sequence: Chemically synthesized oligonucleotide
atgatttccattaaagtct

SEQ ID NO: 11306 - DNA, 19 bp, Artificial Sequence
  Description of Artificial Sequence: Chemically synthesized oligonucleotide
agactttaatggaaatcat

SEQ ID NO: 11307 - DNA, 19 bp, Artificial Sequence
  Description of Artificial Sequence: Chemically synthesized oligonucleotide
tgatttccattaaagtctg

SEQ ID NO: 11308 - DNA, 19 bp, Artificial Sequence
  Description of Artificial Sequence: Chemically synthesized oligonucleotide
cagactttaatggaaatca

SEQ ID NO: 11309 - DNA, 19 bp, Artificial Sequence
  Description of Artificial Sequence: Chemically synthesized oligonucleotide
gatttccattaaagtctgt

SEQ ID NO: 11310 - DNA, 19 bp, Artificial Sequence
  Description of Artificial Sequence: Chemically synthesized oligonucleotide
acagactttaatggaaatc

SEQ ID NO: 11311 - DNA, 19 bp, Artificial Sequence
  Description of Artificial Sequence: Chemically synthesized oligonucleotide
atttccattaaagtctgtt

SEQ ID NO: 11312 - DNA, 19 bp, Artificial Sequence
  Description of Artificial Sequence: Chemically synthesized oligonucleotide
aacagactttaatggaaat

SEQ ID NO: 11313 - DNA, 19 bp, Artificial Sequence
  Description of Artificial Sequence: Chemically synthesized oligonucleotide
tttccattaaagtctgttg

SEQ ID NO: 11314 - DNA, 19 bp, Artificial Sequence
  Description of Artificial Sequence: Chemically synthesized oligonucleotide
caacagactttaatggaaa

SEQ ID NO: 11315 - DNA, 19 bp, Artificial Sequence
  Description of Artificial Sequence: Chemically synthesized oligonucleotide
ttccattaaagtctgttgt

SEQ ID NO: 11316 - DNA, 19 bp, Artificial Sequence
  Description of Artificial Sequence: Chemically synthesized oligonucleotide
acaacagactttaatggaa

SEQ ID NO: 11317 - DNA, 19 bp, Artificial Sequence
  Description of Artificial Sequence: Chemically synthesized oligonucleotide
tccattaaagtctgttgtt

SEQ ID NO: 11318 - DNA, 19 bp, Artificial Sequence
  Description of Artificial Sequence: Chemically synthesized oligonucleotide
aacaacagactttaatgga

SEQ ID NO: 11319 - DNA, 19 bp, Artificial Sequence
  Description of Artificial Sequence: Chemically synthesized oligonucleotide
ccattaaagtctgttgttt

SEQ ID NO: 11320 - DNA, 19 bp, Artificial Sequence
  Description of Artificial Sequence: Chemically synthesized oligonucleotide
aaacaacagactttaatgg

SEQ ID NO: 11321 - DNA, 19 bp, Artificial Sequence
  Description of Artificial Sequence: Chemically synthesized oligonucleotide
cattaaagtctgttgtttt

SEQ ID NO: 11322 - DNA, 19 bp, Artificial Sequence
  Description of Artificial Sequence: Chemically synthesized oligonucleotide
aaaacaacagactttaatg

SEQ ID NO: 11323 - DNA, 19 bp, Artificial Sequence
  Description of Artificial Sequence: Chemically synthesized oligonucleotide
attaaagtctgttgttttg

SEQ ID NO: 11324 - DNA, 19 bp, Artificial Sequence
  Description of Artificial Sequence: Chemically synthesized oligonucleotide
caaaacaacagactttaat

SEQ ID NO: 11325 - DNA, 19 bp, Artificial Sequence
  Description of Artificial Sequence: Chemically synthesized oligonucleotide
ttaaagtctgttgttttgt

SEQ ID NO: 11326 - DNA, 19 bp, Artificial Sequence
  Description of Artificial Sequence: Chemically synthesized oligonucleotide
acaaaacaacagactttaa

SEQ ID NO: 11327 - DNA, 19 bp, Artificial Sequence
  Description of Artificial Sequence: Chemically synthesized oligonucleotide
taaagtctgttgttttgtg

SEQ ID NO: 11328 - DNA, 19 bp, Artificial Sequence
  Description of Artificial Sequence: Chemically synthesized oligonucleotide
cacaaaacaacagacttta

SEQ ID NO: 11329 - RNA, 19 nt, Artificial Sequence
  Description of Artificial Sequence: Chemically synthesized oligonucleotide
cucuccagacauuuggcaa

SEQ ID NO: 11330 - RNA, 19 nt, Artificial Sequence
  Description of Artificial Sequence: Chemically synthesized oligonucleotide
gugcggccgauccgcgccg

SEQ ID NO: 11331 - RNA, 19 nt, Artificial Sequence
  Description of Artificial Sequence: Chemically synthesized oligonucleotide
cggcgcggaucggccgcac

SEQ ID NO: 11332 - RNA, 19 nt, Artificial Sequence
  Description of Artificial Sequence: Chemically synthesized oligonucleotide
ucucccgggagccacuccc

SEQ ID NO: 11333 - RNA, 19 nt, Artificial Sequence
  Description of Artificial Sequence: Chemically synthesized oligonucleotide
cccgggagccacucccaug

SEQ ID NO: 11334 - RNA, 19 nt, Artificial Sequence
  Description of Artificial Sequence: Chemically synthesized oligonucleotide
caugggaguggcucccggg

SEQ ID NO: 11335 - RNA, 20 nt, Artificial Sequence
  Description of Artificial Sequence: Chemically synthesized oligonucleotide
cccgggagccacucccaugg

SEQ ID NO: 11336 - RNA, 20 nt, Artificial Sequence
  Description of Artificial Sequence: Chemically synthesized oligonucleotide
ccaugggaguggcucccggg

SEQ ID NO: 11337 - RNA, 21 nt, Artificial Sequence
  Description of Artificial Sequence: Chemically synthesized oligonucleotide
cccgggagccacucccauggg

SEQ ID NO: 11338 - RNA, 21 nt, Artificial Sequence
  Description of Artificial Sequence: Chemically synthesized oligonucleotide
cccaugggaguggcucccggg

SEQ ID NO: 11339 - RNA, 22 nt, Artificial Sequence
  Description of Artificial Sequence: Chemically synthesized oligonucleotide
cccgggagccacucccaugggc

SEQ ID NO: 11340 - RNA, 22 nt, Artificial Sequence
  Description of Artificial Sequence: Chemically synthesized oligonucleotide
gcccaugggaguggcucccggg

SEQ ID NO: 11341 - RNA, 23 nt, Artificial Sequence
  Description of Artificial Sequence: Chemically synthesized oligonucleotide
cccgggagccacucccaugggcg

SEQ ID NO: 11342 - RNA, 23 nt, Artificial Sequence
  Description of Artificial Sequence: Chemically synthesized oligonucleotide
cgcccaugggaguggcucccggg

SEQ ID NO: 11343 - RNA, 24 nt, Artificial Sequence
  Description of Artificial Sequence: Chemically synthesized oligonucleotide
cccgggagccacucccaugggcgc

SEQ ID NO: 11344 - RNA, 24 nt, Artificial Sequence
  Description of Artificial Sequence: Chemically synthesized oligonucleotide
gcgcccaugggaguggcucccggg

SEQ ID NO: 11345 - RNA, 25 nt, Artificial Sequence
  Description of Artificial Sequence: Chemically synthesized oligonucleotide
cccgggagccacucccaugggcgcc

SEQ ID NO: 11346 - RNA, 25 nt, Artificial Sequence
  Description of Artificial Sequence: Chemically synthesized oligonucleotide
ggcgcccaugggaguggcucccggg

SEQ ID NO: 11347 - RNA, 26 nt, Artificial Sequence
  Description of Artificial Sequence: Chemically synthesized oligonucleotide
cccgggagccacucccaugggcgccu

SEQ ID NO: 11348 - RNA, 26 nt, Artificial Sequence
  Description of Artificial Sequence: Chemically synthesized oligonucleotide
aggcgcccaugggaguggcucccggg

SEQ ID NO: 11349 - RNA, 27 nt, Artificial Sequence
  Description of Artificial Sequence: Chemically synthesized oligonucleotide
cccgggagccacucccaugggcgccuc

SEQ ID NO: 11350 - RNA, 27 nt, Artificial Sequence
  Description of Artificial Sequence: Chemically synthesized oligonucleotide
gaggcgcccaugggaguggcucccggg

SEQ ID NO: 11351 - RNA, 28 nt, Artificial Sequence
  Description of Artificial Sequence: Chemically synthesized oligonucleotide
cccgggagccacucccaugggcgccucu

SEQ ID NO: 11352 - RNA, 28 nt, Artificial Sequence
  Description of Artificial Sequence: Chemically synthesized oligonucleotide
agaggcgcccaugggaguggcucccggg

SEQ ID NO: 11353 - RNA, 29 nt, Artificial Sequence
  Description of Artificial Sequence: Chemically synthesized oligonucleotide
cccgggagccacucccaugggcgccucuc

SEQ ID NO: 11354 - RNA, 29 nt, Artificial Sequence
  Description of Artificial Sequence: Chemically synthesized oligonucleotide
gagaggcgcccaugggaguggcucccggg

SEQ ID NO: 11355 - DNA, 21 bp, Artificial Sequence
  Description of Artificial Sequence: Chemically synthesized oligonucleotide
  Description of DNA/RNA Hybrid: Synthetic oligonucleotide
ggacaugcucccacuugugtt

SEQ ID NO: 11356 - DNA, 21 bp, Artificial Sequence
  Description of Artificial Sequence: Chemically synthesized oligonucleotide
  Description of DNA/RNA Hybrid: Synthetic oligonucleotide
cacaagugggagcaugucctt

SEQ ID NO: 11357 - DNA, 21 bp, Artificial Sequence
  Description of Artificial Sequence: Chemically synthesized oligonucleotide
  Description of DNA/RNA Hybrid: Synthetic oligonucleotide
ggaggccaugcuuacccautt

SEQ ID NO: 11358 - DNA, 21 bp, Artificial Sequence
  Description of Artificial Sequence: Chemically synthesized oligonucleotide
  Description of DNA/RNA Hybrid: Synthetic oligonucleotide
auggguaagcauggccucctt

SEQ ID NO: 11359 - DNA, 21 bp, Artificial Sequence
  Description of Artificial Sequence: Chemically synthesized oligonucleotide
  Description of DNA/RNA Hybrid: Synthetic oligonucleotide
ggacacacucucacuggugtt

SEQ ID NO: 11360 - DNA, 21 bp, Artificial Sequence
  Description of Artificial Sequence: Chemically synthesized oligonucleotide
  Description of DNA/RNA Hybrid: Synthetic oligonucleotide
caccagugagagugugucctt

SEQ ID NO: 11361 - DNA, 21 bp, Artificial Sequence
  Description of Artificial Sequence: Chemically synthesized oligonucleotide
  Description of DNA/RNA Hybrid: Synthetic oligonucleotide
gggcuuuuaccacaaggautt

SEQ ID NO: 11362 - DNA, 21 bp, Artificial Sequence
  Description of Artificial Sequence: Chemically synthesized oligonucleotide
  Description of DNA/RNA Hybrid: Synthetic oligonucleotide
auccuugugguaaaagccctt

SEQ ID NO: 11363 - DNA, 20 bp, Artificial Sequence
  Description of Artificial Sequence: Chemically synthesized primer
ttctaccgcggtcaaactct

SEQ ID NO: 11364 - DNA, 20 bp, Artificial Sequence
  Description of Artificial Sequence: Chemically synthesized primer
ttggtgtcagggatccaaag

SEQ ID NO: 11365 - DNA, 20 bp, Artificial Sequence
  Description of Artificial Sequence: Chemically synthesized primer
agccacatcgctcagaacac

SEQ ID NO: 11366 - DNA, 21 bp, Artificial Sequence
  Description of Artificial Sequence: Chemically synthesized primer
gaggcattgctgatgatcttg

SEQ ID NO: 11367 - DNA, 21 bp, Artificial Sequence
  Description of Artificial Sequence: Chemically synthesized primer
acatcaaagaagagaccccag

SEQ ID NO: 11368 - DNA, 21 bp, Artificial Sequence
  Description of Artificial Sequence: Chemically synthesized primer
ttcgcactggtgacaatggaa

SEQ ID NO: 11369 - DNA, 21 bp, Artificial Sequence
  Description of Artificial Sequence: Chemically synthesized primer
gtgaacggatttggccgtatt

SEQ ID NO: 11370 - DNA, 21 bp, Artificial Sequence
  Description of Artificial Sequence: Chemically synthesized primer
ttttggctccacccttcaagt

SEQ ID NO: 11371 - DNA, 20 bp, Artificial Sequence
  Description of Artificial Sequence: Chemically synthesized primer
ccctggttaagcagtacagc

SEQ ID NO: 11372 - DNA, 21 bp, Artificial Sequence
  Description of Artificial Sequence: Chemically synthesized primer
caggactagaacacctgctaa

SEQ ID NO: 11373 - DNA, 25 bp, Artificial Sequence
  Description of Artificial Sequence: Chemically synthesized oligonucleotide
gcaggagacaccggagacaatcata

SEQ ID NO: 11374 - DNA, 25 bp, Artificial Sequence
  Description of Artificial Sequence: Chemically synthesized oligonucleotide
ggactcttcaacacccactggagat

SEQ ID NO: 11375 - DNA, 25 bp, Artificial Sequence
  Description of Artificial Sequence: Chemically synthesized oligonucleotide
ccaagtctgggccaagtttgacatt

SEQ ID NO: 11376 - DNA, 25 bp, Artificial Sequence
  Description of Artificial Sequence: Chemically synthesized oligonucleotide
ccacaaccttcctgcaatggagatt

SEQ ID NO: 11377 - DNA, 25 bp, Artificial Sequence
  Description of Artificial Sequence: Chemically synthesized oligonucleotide
gcaatggagattccaatcggaccaa

SEQ ID NO: 11378 - DNA, 25 bp, Artificial Sequence
  Description of Artificial Sequence: Chemically synthesized oligonucleotide
ccagtgatgaccgcattaccaacat

SEQ ID NO: 11379 - DNA, 25 bp, Artificial Sequence
  Description of Artificial Sequence: Chemically synthesized oligonucleotide
gcaggtagtagaacggaagatccaa

SEQ ID NO: 11380 - DNA, 25 bp, Artificial Sequence
  Description of Artificial Sequence: Chemically synthesized oligonucleotide
cctggtatcgagcacagaaagattt

SEQ ID NO: 11381 - DNA, 25 bp, Artificial Sequence
  Description of Artificial Sequence: Chemically synthesized oligonucleotide
gcacaatcagtgtcactcagcactt

SEQ ID NO: 11382 - DNA, 25 bp, Artificial Sequence
  Description of Artificial Sequence: Chemically synthesized oligonucleotide
gcggaacctgggttgtttggcttaa

SEQ ID NO: 11383 - DNA, 25 bp, Artificial Sequence
  Description of Artificial Sequence: Chemically synthesized oligonucleotide
ggacacatcgatagggaacaaggat

SEQ ID NO: 11384 - DNA, 25 bp, Artificial Sequence
  Description of Artificial Sequence: Chemically synthesized oligonucleotide
cccaactccacaaccttcctgcaat

SEQ ID NO: 11385 - DNA, 25 bp, Artificial Sequence
  Description of Artificial Sequence: Chemically synthesized oligonucleotide
gccatgagcgaatacacatggcctt

SEQ ID NO: 11386 - DNA, 25 bp, Artificial Sequence
  Description of Artificial Sequence: Chemically synthesized oligonucleotide
cctgtgttggtgtcagggatccaaa

SEQ ID NO: 11387 - DNA, 25 bp, Artificial Sequence
  Description of Artificial Sequence: Chemically synthesized oligonucleotide
ccaagattctagagcgagctccctt

SEQ ID NO: 11388 - DNA, 25 bp, Artificial Sequence
  Description of Artificial Sequence: Chemically synthesized oligonucleotide
ggattcctgtgccacttctgaggaa

SEQ ID NO: 11389 - DNA, 25 bp, Artificial Sequence
  Description of Artificial Sequence: Chemically synthesized oligonucleotide
ccacaactttcctgcaatggagatt

SEQ ID NO: 11390 - DNA, 25 bp, Artificial Sequence
  Description of Artificial Sequence: Chemically synthesized oligonucleotide
gcaatggagattccaatcggaccaa

SEQ ID NO: 11391 - DNA, 25 bp, Artificial Sequence
  Description of Artificial Sequence: Chemically synthesized oligonucleotide
gctgctagcctctacagctgtcaaa

SEQ ID NO: 11392 - DNA, 25 bp, Artificial Sequence
  Description of Artificial Sequence: Chemically synthesized oligonucleotide
gcatgagcggattcacatggccttt

SEQ ID NO: 11393 - DNA, 25 bp, Artificial Sequence
  Description of Artificial Sequence: Chemically synthesized oligonucleotide
ccagtgatgaccgcattaccaacat

SEQ ID NO: 11394 - DNA, 25 bp, Artificial Sequence
  Description of Artificial Sequence: Chemically synthesized oligonucleotide
gcaggtagtagaacggaagatccaa

SEQ ID NO: 11395 - DNA, 25 bp, Artificial Sequence
  Description of Artificial Sequence: Chemically synthesized oligonucleotide
cctggtaccgagcacagaaagattt

SEQ ID NO: 11396 - DNA, 25 bp, Artificial Sequence
  Description of Artificial Sequence: Chemically synthesized oligonucleotide
gcacaatcagtgtcactcagcactt

SEQ ID NO: 11397 - DNA, 25 bp, Artificial Sequence
  Description of Artificial Sequence: Chemically synthesized oligonucleotide
gcactcggagcagtttgaatgtcca

SEQ ID NO: 11398 - DNA, 25 bp, Artificial Sequence
  Description of Artificial Sequence: Chemically synthesized oligonucleotide
ggacacatcgatagggaacaaggag

SEQ ID NO: 11399 - DNA, 25 bp, Artificial Sequence
  Description of Artificial Sequence: Chemically synthesized oligonucleotide
gcaccaggtctgggtcaagtttgat

SEQ ID NO: 11400 - DNA, 25 bp, Artificial Sequence
  Description of Artificial Sequence: Chemically synthesized oligonucleotide
ccacaggaccaagagcatcaaagag

SEQ ID NO: 11401 - DNA, 25 bp, Artificial Sequence
  Description of Artificial Sequence: Chemically synthesized oligonucleotide
cctgtgttggtgtcagggatccaaa

SEQ ID NO: 11402 - DNA, 25 bp, Artificial Sequence
  Description of Artificial Sequence: Chemically synthesized oligonucleotide
cagatatgggcagcctatggtgtga

SEQ ID NO: 11403 - DNA, 25 bp, Artificial Sequence
  Description of Artificial Sequence: Chemically synthesized oligonucleotide
cctggtaagcacagtgagcatcact

SEQ ID NO: 11404 - DNA, 25 bp, Artificial Sequence
  Description of Artificial Sequence: Chemically synthesized oligonucleotide
ggtaagcacagtgagcatcactcag

SEQ ID NO: 11405 - DNA, 25 bp, Artificial Sequence
  Description of Artificial Sequence: Chemically synthesized oligonucleotide
gcacagtgagcatcactcagcactt

SEQ ID NO: 11406 - DNA, 25 bp, Artificial Sequence
  Description of Artificial Sequence: Chemically synthesized oligonucleotide
cacagtgagcatcactcagcacttc

SEQ ID NO: 11407 - DNA, 25 bp, Artificial Sequence
  Description of Artificial Sequence: Chemically synthesized oligonucleotide
ggatcctgagcataatggtggccat

SEQ ID NO: 11408 - DNA, 25 bp, Artificial Sequence
  Description of Artificial Sequence: Chemically synthesized oligonucleotide
gcttactcgacactctgagcagttt

SEQ ID NO: 11409 - DNA, 25 bp, Artificial Sequence
  Description of Artificial Sequence: Chemically synthesized oligonucleotide
ggactgttcaatacccactggagat

SEQ ID NO: 11410 - DNA, 25 bp, Artificial Sequence
  Description of Artificial Sequence: Chemically synthesized oligonucleotide
cccagtttgtctccagtcagccttt

SEQ ID NO: 11411 - DNA, 25 bp, Artificial Sequence
  Description of Artificial Sequence: Chemically synthesized oligonucleotide
ccaggtctgggtcaagtttgacatt

SEQ ID NO: 11412 - DNA, 5699 bp, Homo sapiens
tctcccgggagccactcccatgggcgcctctccagcccctggcctggaagcaccaggaaccctggggatggggcagaccctcacagcccggggtctggagccggtgtcggagctcatctgggcccatgacctctccagacatttggcaaaatcaaggcccttagaccagggacagacccaagcccaggccctcccagaggtcctaggacgcaaccctttgtgcccttgggctctggaagaggtttgggaagggtttggggtggaagatggcaaagagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctctcggcaggcgcccgggtgccgcgggggggagggggaacaaagggctcattctccccgtgcgcagccggtggcatcgccggggcgttggcggaagcccccggggcccgggagggggcaggcccaggcgcggccgccgaatcacgggctcctgtttcccgcagggtgctggaggaggaaaccggcggagcagcttccccactctcagttgcgcttctggcgatggcgatcagaggtcctgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgaaaaaaaaaaaaaaaaa

SEQ ID NO: 11413 - DNA, 4981 bp, Homo sapiens
ggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaa

What is claimed is:

1. A method of removing hair from an area of a human, comprising:
   (A) first synchronizing hair growth cycles for hair follicles in said area, wherein said synchronization is accomplished by:
      (i) twice pulling the hair from said follicles; or
      (ii) administering a follicle growth inducer to said area; and
   (B) subsequently applying to said area a double stranded nucleic acid molecule comprising:
      (i) a sense sequence corresponding to 19-29 contiguous nucleotides of SEQ ID NO: 11412; and
      (ii) an antisense sequence complementary thereto, wherein said double stranded nucleic acid molecule inhibits expression of human hairless protein, whereby hair growth in said area is inhibited.

2. The method of claim 1, wherein inhibition of hair growth in said area persists at least one month.

3. The method of claim 1, wherein said double stranded nucleic acid comprises at least one 3'-overhang.

4. The method of claim 3, wherein said 3'-overhang is a 2- or 3'-base overhang.

5. The method of claim 3, wherein said 3'-overhang comprises at least one deoxynucleotide.

6. The method of claim 1, wherein at least one strand of said double stranded nucleic acid comprises at least one nucleotide analog or internucleotidic linkage different from unmodified RNA.

7. The method of claim 1, wherein said sense sequence comprises SEQ ID NO:11329.

8. The method of claim 1, wherein said sense sequence and said antisense sequence each comprises 19 complementary nucleotides and 1 to 3 non-complementary 3'-nucleotides.

9. The method of claim 1, wherein said sense sequence and said antisense sequence each comprises 20 complementary nucleotides and 1 to 3 non-complementary 3'-nucleotides.

10. The method of claim 1, wherein said sense sequence and said antisense sequence each comprises 21 complementary nucleotides and 1 to 3 non-complementary 3'-nucleotides.

11. The method of claim 1, wherein said sense sequence and said antisense sequence each comprises 22 complementary nucleotides and 1 to 3 non-complementary 3'-nucleotides.

12. The method of claim 1, wherein said sense sequence and said antisense sequence each comprises 23 complementary nucleotides and 1 to 3 non-complementary 3'-nucleotides.

13. The method of claim 1, wherein said sense sequence and said antisense sequence each comprises 24 complementary nucleotides and 1 to 3 non-complementary 3'-nucleotides.

14. The method of claim 1, wherein said sense sequence and said antisense sequence each comprises 25 complementary nucleotides and 1 to 3 non-complementary 3'-nucleotides.

15. The method of claim 1, wherein said sense sequence and said antisense sequence each comprises 26 complementary nucleotides and 1 to 3 non-complementary 3'-nucleotides.

16. The method of claim 1, wherein said sense sequence and said antisense sequence each comprises 27 complementary nucleotides and 1 to 3 non-complementary 3'-nucleotides.

17. The method of claim 1, wherein said sense sequence and said antisense sequence each comprises 28 complementary nucleotides and 1 to 3 non-complementary 3'-nucleotides.

18. A method for removing hair from an area of a mammal, comprising:
   (A) synchronizing hair growth cycles for hair follicles in said area, wherein said synchronization is accomplished by:
      (i) twice pulling the hair from said follicles; or
      (ii) administering a follicle growth inducer to said area; and
   (B) subsequently applying to said area a double stranded nucleic acid molecule comprising:
      (i) a sense sequence corresponding to 19-29 contiguous nucleotides of SEQ ID NO: 11412 and
      (ii) an antisense sequence complementary thereto, wherein said double stranded nucleic acid molecule inhibits hairless mRNA translation.

19. The method of claim 18, wherein said mammal is a human.

20. The method of claim 18, wherein inhibition of hair growth in said area persists at least one month.

21. The method of claim 18, wherein said double stranded nucleic acid comprises at least one 3'-overhang.

22. The method of claim 21 wherein said 3'-overhang is a 2- or 3'-base overhang.

23. The method of claim 22 wherein said 3'-overhang comprises at least one deoxynucleotide.

24. The method of claim 18, wherein at least one strand of said double stranded nucleic acid comprises at least one nucleotide analog or internucleotidic linkage different from unmodified RNA.

25. The method of claim 18, wherein said sense sequence comprises SEQ ID NO:11329.

26. The method of claim 18, wherein said sense sequence and said antisense sequence each comprises 19 complementary nucleotides and 1 to 3 non-complementary 3'-nucleotides.

27. The method of claim 18, wherein said sense sequence and said antisense sequence each comprises 20 complementary nucleotides and 1 to 3 non-complementary 3'-nucleotides.

28. The method of claim 18, wherein said sense sequence and said antisense sequence each comprises 21 complementary nucleotides and 1 to 3 non-complementary 3'-nucleotides.

29. The method of claim 18, wherein said sense sequence and said antisense sequence each comprises 22 complementary nucleotides and 1 to 3 non-complementary 3'-nucleotides.

30. The method of claim 18, wherein said sense sequence and said antisense sequence each comprises 23 complementary nucleotides and 1 to 3 non-complementary 3'-nucleotides.

31. The method of claim 18, wherein said sense sequence and said antisense sequence each comprises 24 complementary nucleotides and 1 to 3 non-complementary 3'-nucleotides.

32. The method of claim 18, wherein said sense sequence and said antisense sequence each comprises 25 complementary nucleotides and 1 to 3 non-complementary 3'-nucleotides.

33. The method of claim 18, wherein said sense sequence and said antisense sequence each comprises 26 complementary nucleotides and 1 to 3 non-complementary 3'-nucleotides.

34. The method of claim 18, wherein said sense sequence and said antisense sequence each comprises 27 complementary nucleotides and 1 to 3 non-complementary 3'-nucleotides.

35. The method of claim 18, wherein said sense sequence and said antisense sequence each comprises 28 complementary nucleotides and 1 to 3 non-complementary 3'-nucleotides.

36. A method of inhibiting expression of hairless protein in an area of a mammal, comprising:
   (A) first synchronizing hair growth cycles for hair follicles in said area, wherein said synchronization is accomplished by:
      (i) twice pulling the hair from said follicles; or
      (ii) administering a follicle growth inducer to said area; and
   (B) subsequently applying to said area a double stranded nucleic acid molecule comprising:
      (i) a sense sequence corresponding to 19-29 contiguous nucleotides of SEQ ID NO: 11412; and
      (ii) an antisense sequence complementary thereto.

37. A method for treating a human desirous of losing hair in an area, comprising:
   (A) first synchronizing hair growth cycles for hair follicles in said area, wherein said synchronization is accomplished by:
      (i) twice pulling the hair from said follicles; or
      (ii) administering a follicle growth inducer to said area; and
   (B) subsequently applying to said area a double stranded nucleic acid molecule comprising:
      (i) a sense sequence corresponding to 19-29 contiguous nucleotides of SEQ ID NO: 11412; and
      (ii) an antisense sequence complementary thereto.

* * * * *